United States Patent
Mali et al.

(10) Patent No.: US 12,139,502 B2
(45) Date of Patent: Nov. 12, 2024

(54) AROMATIC BORON-CONTAINING COMPOUNDS AND RELATED INSULIN ANALOGS

(71) Applicant: PROTOMER TECHNOLOGIES INC., Indianapolis, IN (US)

(72) Inventors: Sachitanand Mali, Pasadena, CA (US); Diao Chen, Pasadena, CA (US); Ryan Kelly Spencer, Porter Ranch, CA (US); Jack Joseph Steele, Pasadena, CA (US); Jingxin Liang, Covington, WA (US); Mirna Ekram Anwar Shaker, Cypress, CA (US); Alborz Mahdavi, Pasadena, CA (US)

(73) Assignee: PROTOMER TECHNOLOGIES INC., Indianapolis, IN (US)

( * ) Notice: Subject to any disclaimer, the term of this patent is extended or adjusted under 35 U.S.C. 154(b) by 0 days.

(21) Appl. No.: 18/318,939

(22) Filed: May 17, 2023

(65) Prior Publication Data
US 2023/0374045 A1   Nov. 23, 2023

Related U.S. Application Data

(60) Provisional application No. 63/364,893, filed on May 18, 2022.

(51) Int. Cl.
  *A61K 47/65* (2017.01)
  *A61P 5/50* (2006.01)
  *C07F 5/02* (2006.01)

(52) U.S. Cl.
  CPC ............ *C07F 5/025* (2013.01); *A61K 47/65* (2017.08); *A61P 5/50* (2018.01)

(58) Field of Classification Search
  CPC .................................................. C07F 5/025
  See application file for complete search history.

(56) References Cited

U.S. PATENT DOCUMENTS

| | | | |
|---|---|---|---|
| 4,888,414 | A | 12/1989 | Knutson |
| 8,846,624 | B2 | 9/2014 | Chaikof et al. |
| 9,867,869 | B2 | 1/2018 | Anderson et al. |
| 10,000,571 | B2 | 6/2018 | Ashkenazi et al. |
| 10,584,156 | B2 | 3/2020 | Weiss |
| 11,052,133 | B2 | 7/2021 | Mahdavi |
| 2004/0001827 | A1 | 1/2004 | Dennis |
| 2007/0219346 | A1 | 9/2007 | Trifiro |
| 2010/0048473 | A1 | 2/2010 | Chaikof et al. |
| 2010/0273979 | A1 | 10/2010 | Abrahmsen et al. |
| 2010/0278845 | A1 | 11/2010 | Heavner |
| 2011/0039769 | A1 | 2/2011 | Tagmose et al. |
| 2012/0014908 | A1 | 1/2012 | Zion et al. |
| 2012/0135919 | A1 | 5/2012 | Lancaster et al. |
| 2013/0028918 | A1 | 1/2013 | Song et al. |
| 2014/0037699 | A1 | 2/2014 | Zion et al. |
| 2015/0025005 | A1 | 1/2015 | Langer et al. |
| 2015/0105317 | A1 | 4/2015 | Lin et al. |
| 2016/0082122 | A1 | 3/2016 | Bachelet et al. |
| 2020/0325160 | A1 | 10/2020 | Kruse et al. |
| 2021/0369815 | A1 | 12/2021 | Mahdavi |
| 2023/0134116 | A1* | 5/2023 | Mahdavi ............... A61K 47/542 514/5.9 |

FOREIGN PATENT DOCUMENTS

| | | | |
|---|---|---|---|
| WO | WO 03/048195 A2 | 6/2003 | |
| WO | WO 2014/093696 A2 | 6/2014 | |
| WO | WO 2017/070617 A1 | 4/2017 | |
| WO | WO 2019/092125 A1 | 5/2019 | |
| WO | WO 2019/204206 A1 | 10/2019 | |
| WO | WO 2020/201041 A2 | 10/2020 | |
| WO | WO 2021/022116 A1 | 2/2021 | |
| WO | WO 2021/202802 A1 | 10/2021 | |
| WO | WO2022109078 | * 5/2022 | ............ C07K 14/62 |
| WO | WO2022235691 | * 11/2022 | ............ C07K 14/62 |

OTHER PUBLICATIONS

Bartlett "Exploiting Chemical Diversity for Drug Discovery" Edited by Paul A Bartlett and Michael Entzeroth, The Royal Society of Chemistry, 2006, pp. 113-118.*
"Find ETDs Home » Thesis Resources » Find ETDs" Online: "https://ndltd.org/thesis-resources/find-etds/" Accessed Jan. 31, 2023.*
Irwin "ZINC—A Free Database of Commercially Available Compounds for Virtual Screening" J. Chem. Inf. Model. 2005, 45, 177-182.*
Kim "PubChem in 2021: new data content and improved web interfaces" Nucleic Acids Research, 2021, vol. 49, Database issue Published online Nov. 5, 2020.*
STN Registry/Zregistry (CAS Registrysm) Sep. 2016 2 pages.*
Chu, M.K.L. et al., "In Vitro and in vivo testing of glucose-responsive insulin-delivery microdevices in diabetic rats," Lab on a Chip, The Royal Society of Chemistry, pp. 2533-2539 (2012).
Ding, Z. et al., "Synthesis of glucose-sensitive self-assembled films and their application in controlled drug delivery," Polymer, vol. 50, pp. 4205-4122 (2009).
Dowlut, Meenakshi et al., "An Improved Class of Sugar-Binding Boronic Acis, Soluble and Capable of Complexing Glycosides in Neutral Water," J. Am. Chem. Soc., vol. 128, pp. 4226-4227 (2006).
European Search Report issued in corresponding application No. EP16790212.1, 11 pages (2018).

(Continued)

*Primary Examiner* — Nizal S Chandrakumar
(74) *Attorney, Agent, or Firm* — FINNEGAN, HENDERSON, FARABOW, GARRETT & DUNNER, LLP

(57) ABSTRACT

The disclosure relates to novel compounds that include one or more aromatic boron-containing groups and methods of making the disclosed compounds. The present disclosure further relates to pharmaceutical compositions comprising the disclosed compounds, and their use in prevention and treatment of diseases and disorders.

51 Claims, No Drawings
Specification includes a Sequence Listing.

(56) References Cited

OTHER PUBLICATIONS

Hoeg-Jensen, Thomas, "Preparation and Screening of Diboronate Arrays for Identification of Carbohydrate Binders," QSAR & Combinatorial Science, vol. 23, No. 5, pp. 344-351 (2004).

Hoeg-Jensen, Thomas et al., "Insulins with built-in glucose sensors for glucose responsive insulin release," Journal of Peptide Science, vol. 11, pp. 339-346 (2005).

Menting, John G. et al., "Protective hinge in insulin opens to enable its receptor engagement," Proceedings of the National Academy of Sciences, vol. 111, pp. 3395-3404 (2014).

Pal, Arnab et al., "Design, Synthesis, and Screening of a Library of Peptidyl Bis(Boroxoles) as Oligosaccharide Receptors in Water: Identification of a Receptor for the Tumor Marker TF-Antigen Disaccharide," Angewandte Chemie International Edition, vol. 49, No. 8, pp. 1492-1495 (2010).

Qi, W., "Glucose Sensitive Micro capsules from Glutaraldehyde Cross-Linked Hemoglobin and Glucose Oxidase," Biomacromolecules, vol. 10, pp. 1212-1216 (2009).

Tan, Lei et al., "Glucose- and pH-Responsive Nanogated Ensemble Based on Polymeric Network Capped Mesoporous Silica," Applied Materials & Interfaces, vol. 7, No. 11, pp. 6310-6316 (2015).

Wu, Xin et al., "Selective sensing of saccharides using simple boronic acids and their aggregates," Chem. Soc. Rev., vol. 42, No. 20, pp. 8032-8048 (2013).

International Search Report for International Application No. PCT/US2021/059802, dated Mar. 9, 2022 (7 pages).

Written Opinion of the International Search Authority for International Application No. PCT/US2021/059802, dated Mar. 9, 2022 (12 pages).

International Search Report for International Application No. PCT/US2021/025261, dated Jul. 1, 2021 (6 pages).

Written Opinion of the International Search Authority for International Application No. PCT/US2021/025261, mailed Jul. 1, 2021.

* cited by examiner

AROMATIC BORON-CONTAINING COMPOUNDS AND RELATED INSULIN ANALOGS

CROSS REFERENCES TO RELATED APPLICATIONS

This application claims priority from U.S. Provisional Patent Application No. 63/364,893, filed May 18, 2022, which is incorporated herein by reference.

FIELD OF THE DISCLOSURE

The present disclosure relates to novel compounds that include one or more aromatic boron-containing groups. The disclosure relates to the use of the novel compounds to bind glucose. The present disclosure further relates to kits and the use of the compounds and/or pharmaceutical compositions comprising the disclosed compounds for the treatment of disorders characterized by elevated glucose levels, such as hyperglycemia, type 2 diabetes, impaired glucose tolerance, and type 1 diabetes, as well as obesity, metabolic syndromes, neurological diseases, mood disorders, and psychiatric disorders.

SEQUENCE LISTING

The present application is being filed along with a Sequence Listing in electronic format. The Sequence Listing is provided as a file titled 02021_00153-00304_SL.xml, created Apr. 7, 2023, and is 6,324,718 bytes in size. The information in the electronic format of the Sequence Listing is incorporated herein by reference in its entirety.

BACKGROUND OF THE DISCLOSURE

Boronic acids are generally considered Lewis acids that have a tendency to bind to hydroxyls, because, as Lewis acids, boronic acids can form complexes with Lewis bases such as, for example, hydroxide anions. Thus, molecules containing boronates including boronic acids have a general tendency to bind hydroxyl groups. This binding tendency can be used for detection of hydroxyl-containing groups by boronated labeling reagents wherein the boronate groups bind to the hydroxyls and, depending on the solvent and buffer conditions, the boronates can form hydrolysable boronate-ester bonds to the hydroxyl groups of hydroxyl containing molecules, such as the hydroxyl groups present in diols (e.g., glucose). Although boron-containing compounds can bind to diol containing molecules, achieving selectivity using boron-containing compounds has been challenging because of their ability to bind various diols, including cis diols, to varying degrees. While improved binding affinity of boron-containing compounds towards a specific vicinal diol of interest may be achieved, this may result in a loss of selectivity.

Glucose is the main fuel for the human body, and blood glucose values are tightly regulated in healthy individuals. For example, between meals, blood glucose is near 5 mmol/L (mM), and when blood glucose concentrations rise after a meal, the value is quickly adjusted back toward 5 mM by the action of insulin. The hormone insulin is secreted from pancreatic beta cells, and when insulin binds to insulin receptors on cells in the body (for example muscle and fat), the cells are stimulated to absorb glucose by translocation of glucose transporters from storage vesicles to the cell surface (GLUT4). (Huang, S. H. et al. (2007) Cell Metabolism 5:237-252.)

People with diabetes may lose their ability to produce insulin due to autoimmunity against beta cells (type 1) or have low sensitivity to insulin in combination with impaired insulin secretion (type 2). For example, those with type 1 diabetes may rely on multiple daily insulin injections, both for basal coverage, typically once a day, and with meals (bolus) to control their glucose levels. (Polonsky, K. S. et al. (1988) The Journal of Clinical Investigation 81: 442-448.) Because glucose values can fluctuate unpredictably, perfect insulin dosing day after day is extremely difficult. Indeed, despite many technological advances in diabetes treatment, researchers are currently observing, partly due to lifestyle problems, a worsening of long-term glucose control and/or overall metabolic health.

Glucose sensors and glucose sensing insulin analogs are known in the art. See, e.g., WO 2016/179568 A1 and WO 2021/202802 A1. However, there is a need in the art to develop glucose sensors and glucose sensing insulins that have improved properties, such as binding to the insulin receptor and be proportionately responsive to different glucose concentrations and provide a graded and reversible response to changes in glucose levels under physiological conditions.

Thus, there is an unmet medical need for novel compounds, such as compounds which bind glucose and may be utilized in glucose-responsive insulin analogues/conjugates, that can control blood glucose levels.

Here, we disclose glucose sensors and glucose sensing insulin analogs that have improved properties, such as improved affinity for glucose at relatively low concentrations, improved affinity for the insulin receptor, and improved activation of the insulin receptor.

SUMMARY OF THE DISCLOSURE

The present disclosure provides, according to some embodiments, novel Z1c compounds (e.g., FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226) comprising aromatic boron-containing functionalities (e.g., F2, F5, and F10). In some embodiments, the present disclosure provides indirect linkers represented by Formula $(X'')_{n1}$ where $X''$ is as defined herein and each $n1$ is 1, 2, 3, 4, or 5 (e.g., as exemplified in Formulae FL3, FL5, FL5A, FL5B, and FL20-FL75). In some embodiments, the present disclosure provides novel Z1c-Linker(s) (e.g., Formulae FFL-1 to FFL-101) comprising aromatic boron-containing functionalities (e.g., F2, F5, and F10).

In some embodiments, the present disclosure provides compounds that comprise a drug substance (e.g., X1) and at least one Z1c with aromatic boron-containing functionalities. In some embodiments, the compounds disclosed comprise one or more scaffolds (e.g., FF scaffolds and Z1c-Linker scaffolds as exemplified in Formulae FFL-1 to FFL-101). In some embodiments, the compounds comprise a drug substance. In at least some embodiments, the drug substance is a polypeptide or a small-molecule.

In at least some embodiments, the disclosed compounds have at least two aromatic boron-containing functionalities. In some embodiments, the compounds are selective towards specific sugars, such as glucose, while showing reduced affinity for other sugars and wherein there is at least two aromatic boron-containing functionalities in the aromatic boron-containing portion of the compounds. In certain embodiments, the aromatic boron-containing portion may be covalently conjugated, directly or indirectly, to a drug substance comprising an amine, a drug substance that is covalently conjugated to an amine containing linker, or $NH_2$, or OH (e.g., where X1 is $NH_2$ or OH). In some embodiments, the drug substance is covalently conjugated to an amine containing linker and the amine group is conjugated to the aromatic boron-containing portion (Z1c). In certain embodiments, the aromatic boron-containing portion (Z1c) has an architecture comprising of tethering groups (FF formulae) and aromatic boron containing groups that collectively make the aromatic boron-containing portion of the disclosed compounds. In some embodiments, the aromatic boron-containing portion (Z1c) is covalently conjugated to an indirect linker (e.g, Formulae FL3, FL5, FL5A, FL5B, and FL20-FL75) and has an architecture comprising tethering groups (FF formulae), and aromatic boron containing groups that collectively make the aromatic boron-containing portion of the disclosed compounds.

In some embodiments, one or more Z1c may be linked (e.g., conjugated, connected) to a drug substance (e.g., X1) via one or more indirect linkers (e.g., Formulae FL3, FL5, FL5A, FL5B, and FL20-FL75 and/or one or more L- or D-amino acids connected together using amide or peptide bonds). In at least some embodiments, rotational constraining of the boron functionalities via the tethering group (e.g., FF formulae) enhances the binding affinity of the compounds (e.g., conjugates) towards specific diols (such as glucose) and away from other diols in the body and thereby provides selectivity to specific diols. In some embodiments, the compounds may exhibit therapeutic pharmacokinetics and/or pharmacodynamics in response to endogenous and/or exogenous small molecules in the body, such as glucose. Changes in the physiological concentration of glucose, may result in the activation and/or release of the drug molecule or conversely, may result in the deactivation and/or sequestering of the drug molecule (e.g., a peptide hormone), and/or modulation of the activity of the drug molecule, through interaction of glucose with the boron-containing architectures conjugated to the drug molecule.

In some embodiments, the present disclosure provides a compound comprising X1 and one or more Z1c, or a tautomer, stereoisomer or a mixture of stereoisomers, or a pharmaceutically acceptable salt, or hydrate, or isotopic derivative thereof, wherein:

X1 comprises:
  i. a drug substance comprising an amine;
  ii. an amine configured to be covalently conjugated to a drug substance; or
  iii. $NH_2$ or OH (e.g. X1 is $NH_2$ or OH);
wherein each Z1c is independently selected from Formulae FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226; and wherein each Z1c is covalently conjugated, directly or indirectly, to an amine in X1 or to $NH_2$ which X1 is $NH_2$ or to OH when X1 is OH.

In some embodiments, the present disclosure provides a compound represented by Formula I, or a stereoisomer or a mixture of stereoisomers, or pharmaceutically acceptable salt thereof:

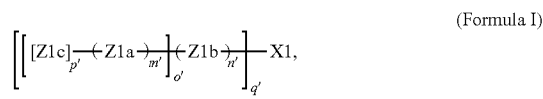
(Formula I)

wherein:
X1 comprises:
  i. a drug substance comprising an amine;
  ii. an amine configured to be covalently conjugated to a drug substance; or
  iii. $NH_2$ or OH (e.g. X1 is $NH_2$ or OH);
each Z1a independently comprises 1 to 50 amino acids connected together using amide or peptide bonds;
each Z1b is independently a small-molecule linker;
each Z1c is independently selected from Formulae FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226, wherein each Z1c is covalently conjugated either directly or via an indirect linker to an amine of Z1a or to an amine of X1 or to $NH_2$ when X1 is $NH_2$ or to OH when X1 is OH;
each m' is 0 or 1;
each n' is 0;
each o' is 1;
each p' is 1, 2, 3, 4, 5, 6, 7, 8, 9, or 10; and
each q' is 1, 2, 3, 4, or 5, wherein when p' or q' is 2 or more, each corresponding Z1c is independently selected and may be the same or different and wherein when q' is 2 or more, each corresponding Z1a is independently selected and may be the same or different;
when m'=0 and n'=0, each Z1c is covalently conjugated either directly or via an indirect linker to an amine of X1 or to $NH_2$ when X1 is $NH_2$, or to OH when X1 is OH, and for m'=1 each Z1a is covalently conjugated via an amide or peptide bond to X1 and each Z1c is covalently conjugated either directly or via an indirect linker to an amine of Z1a or to X1;
and
wherein in Formulae FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226 are:

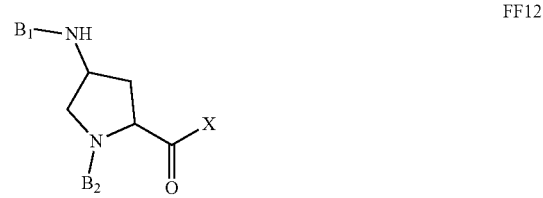
FF12

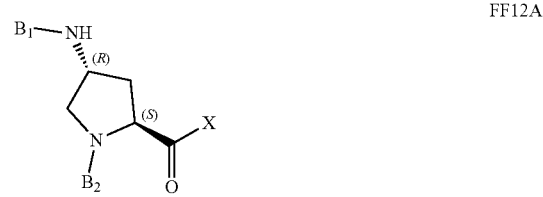
FF12A

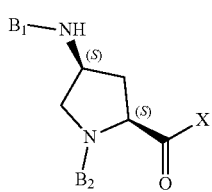
FF12B
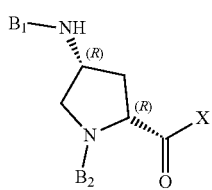
FF12C
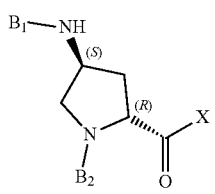
FF12D
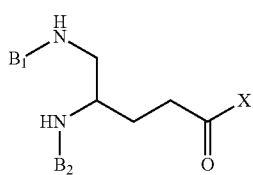
FF114
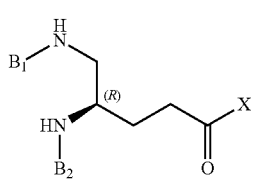
FF114A
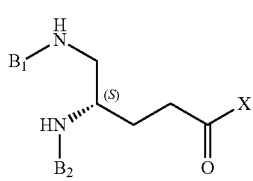
FF114B
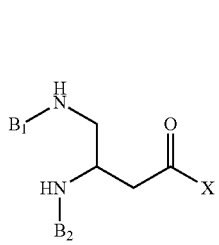
FF115
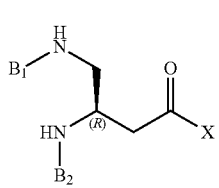
FF115A
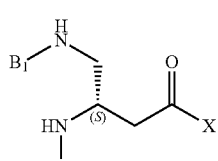
FF115B
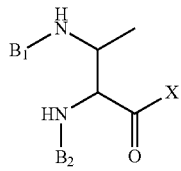
FF116
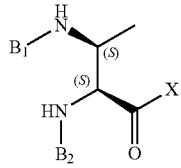
FF116A
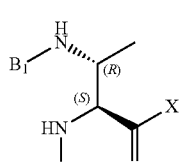
FF116B
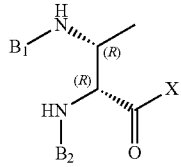
FF116C
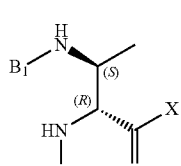
FF116D
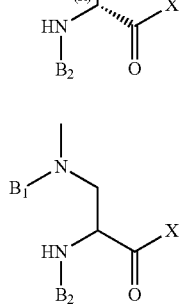
FF117
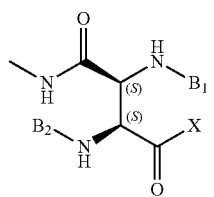
FF193A -continued

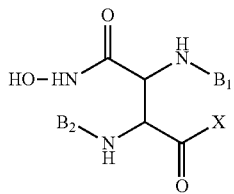
FF203

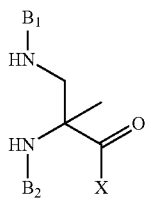
FF225

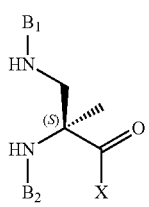
FF225A

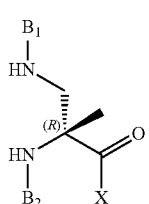
FF225B

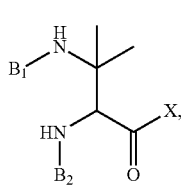
FF226 wherein X represents a point of covalent attachment either directly to an amine of X1 or to $NH_2$ when X1 is $NH_2$ or to OH when X1 is OH or to an amine that is covalently conjugated directly or indirectly to X1; and wherein $B_1$ and $B_2$, which may be identical or different, each independently represent an aromatic boron-containing group; and wherein one or more positions of the compound of Formula I may comprise an isotope (e.g., $^2H$ or $^{14}C$).

In some embodiments, X1 is OH or $NH_2$. In some embodiments, the compound disclosed herein (e.g., Formula I, Formula II) is conjugated directly or via an optional linker to a drug substance.

In some embodiments, the compound of Formula I comprises:
at least one Z1c covalently conjugated via the indirect linker to X1 or to Z1a, wherein the indirect linker is represented by Formula $(X'')_{n1}$,
each n1 is independently selected from 1, 2, 3, 4, and 5, and
each X'' is independently selected from:
(i) an L- or D-amino acid, wherein an amine functional group of the L- or D-amino acid is covalently conjugated, directly or indirectly, to Z1c and an acid functional group of the L- or D-amino acid is conjugated, directly or indirectly, to X1 or to Z1a; and
(ii) Formulae FL3, FL5, FL5A, FL5B, FL20-FL68, and FL71-FL75 which comprise substituents R'' and Z'', and Formulae FL69 and FL70, which comprise substituents R'', Z'', A', and A'', and stereoisomers thereof;
wherein:
R'' represents a covalent bond, directly or indirectly, to Z1c;
Z'' represents a covalent bond, directly or indirectly, to X1 or to Z1a;
A' is selected from H, an alkyl group (e.g., $C_1$-$C_6$alkyl group), a saturated fatty acid, an unsaturated fatty acid, a cycloalkyl group (e.g., ($C_3$-$C_6$)cycloalkyl), a haloalkyl group (e.g., $C_1$-$C_6$haloalkyl group), an aryl group, and a heteroaryl group; and
A'' is selected from one of an alkyl group (e.g., $C_1$-$C_6$alkyl group), a substituted acyl group, acyl group terminating in an acid group, a saturated fatty acid, an unsaturated fatty acid, a cycloalkyl group (e.g., ($C_3$-$C_6$)cycloalkyl), a haloalkyl group (e.g., $C_1$-$C_6$ haloalkyl group), an aryl group, and a heteroaryl group;
p is 1, 2, 3, 4, or 5,
q is 1, 2, 3, 4, or 5, and
any primary amine is optionally acetylated or alkylated.
In some embodiments, n1 is 1.
In some embodiments of the compound of Formula I, m'=0, n'=0, o'=0, and the compound is represented by Formula IC:

$$\left[ [Z1c]_{p'} \right]_{q'} X1; \quad \text{(Formula IC)}$$

each p' is 1, 2, 3, or 4; and
each q' is 1, 2, 3, 4, or 5.
In some embodiments, each $B_1$ and $B_2$ is Formula F2.
In some embodiments, each Z1c is covalently conjugated to an indirect linker and each of the Z1c and the indirect linker in combination is selected from Formulae FFL-1 to FFL-101, which comprise substituent X; wherein X represents a point of covalent attachment either directly to an amine of X1 or to $NH_2$ when X1 is $NH_2$ or to OH when X1 is OH or to an amine that is covalently conjugated directly or indirectly to X1 or to an amine of Z1a.

In some embodiments, X1 is a polypeptide comprising an insulin receptor agonist having an A-chain and a B-chain.

In some embodiments, at least one Z1c comprises an alpha methyl group or a beta methyl group.

Also disclosed herein are methods of treatment. The disclosed methods may comprise treating a subject in need thereof, wherein the subject has a disease characterized by elevated glucose levels. The methods may comprise administering to a subject in need thereof a compound of Formula I, a pharmaceutically acceptable salt of a compound of Formula I, a pharmaceutical composition comprising a compound of Formula I, or a pharmaceutical composition comprising a pharmaceutically acceptable salt of a compound of Formula I.

Also disclosed herein is a method of treating or preventing an endocrine and/or metabolic disease, in a subject in need thereof, comprising administering to said subject a compound of Formula I, or a pharmaceutically acceptable salt thereof, or a pharmaceutical composition comprising a compound of Formula I or a pharmaceutically acceptable salt thereof. In some embodiments, the compound of Formula (I) comprises a drug substance, wherein the drug substance is a polypeptide human hormone, an endocrine hormone, insulin, human insulin, glucagon, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, or an analogue thereof.

In some embodiments, the compound of Formula (I), or a pharmaceutically acceptable salt thereof, or a pharmaceutical composition comprising a compound of Formula I or a pharmaceutically acceptable salt thereof, is administered simultaneously with a second agent or therapy. In some embodiments, the second agent is a drug substance, wherein the drug substance is a polypeptide human hormone, an endocrine hormone, insulin, human insulin, glucagon, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, or an analogue thereof. In some embodiments, the compound of Formula (I), or a pharmaceutically acceptable salt thereof, or a pharmaceutical composition comprising a compound of Formula I or a pharmaceutically acceptable salt thereof, is administered concurrently with the second agent or therapy. In some embodiments, the compound of Formula (I), or a pharmaceutically acceptable salt thereof, or a pharmaceutical composition comprising a compound of Formula I or a pharmaceutically acceptable salt thereof, is administered sequentially with the second agent or therapy (e.g., where a compound of Formula (I) is administered initially and the second agent or therapy is administered subsequently or where the second agent or therapy is administered initially and the compound of Formula (I) is administered subsequently) In some embodiments, the compound of Formula (I), or a pharmaceutically acceptable salt thereof, or a pharmaceutical composition comprising a compound of Formula I or a pharmaceutically acceptable salt thereof, is administered in the same unit dosage form as the second agent or therapy. In some embodiments, the compound of Formula (I), or a pharmaceutically acceptable salt thereof, or a pharmaceutical composition comprising a compound of Formula I or a pharmaceutically acceptable salt thereof, is administered in a different unit dosage form from the second agent or therapy.

In at least one embodiment, the pharmaceutical composition of the present disclosure may be for use in (or in the manufacture of medicaments for) the treatment of diseases characterized by elevated glucose in a subject such as diabetes. In at least one embodiment, a therapeutically-effective amount of a pharmaceutical composition of the present disclosure may be administered to a subject diagnosed with diabetes or metabolic disease. In at least one embodiment, the pharmaceutical composition of the present disclosure comprises at least one compound disclosed herein (e.g., Formula I, Z1c, Z1c-Linker) and at least one additional component selected from pharmaceutically acceptable carriers, pharmaceutically acceptable vehicles, and pharmaceutically acceptable excipients.

In some embodiments, the disclosed compounds comprise an insulin receptor agonist selected from insulin and an insulin analogue (e.g., where X1 is insulin or an insulin analogue). In some embodiments, X1 comprises an insulin having an A-chain and a B-chain, wherein the A-chain comprises a sequence selected from SEQ ID NOs 1, 25, 24051, and 24052, and the B-chain comprises a sequence selected from SEQ ID NOs 24060, 24061, 24062, 24063, 24064, and 25000-25397.

In some embodiments, X1 comprises an insulin having an A-chain and a B-chain, wherein:
the A-chain comprises a sequence selected from SEQ ID NOs 24051 and 24052,
the B-chain comprises a sequence selected from SEQ ID NOs 25095, 25229, 25232, 25236, 25305, 25308, 25312, and 25380-25397;
each Z1c is independently selected from FF12A, FF12B, FF12C, FF12D, FF116A, FF116B, FF116C, FF116D, and covalently conjugated either directly or via the indirect linker to one or more lysine residues in X1;
$B_1$ and $B_2$ is each F2; and
the indirect linker is independently selected from FL3, FL5, FL5A, FL5B, FL20-FL75, and stereoisomers thereof.

In some embodiments, the compound is selected from an insulin comprising an A-chain and a B-chain, wherein the A-chain comprises a sequence selected from SEQ ID NOs 24501 and 24502; and wherein the B-chain comprises a sequence selected from SEQ ID NOs 25229, 25232, 25305, 25308, 25312, 25236, 25095, and 25380-25397.

In some embodiments, the present disclosure provides a compound represented by Formula II, or a stereoisomer or a mixture of stereoisomers, or pharmaceutically acceptable salt thereof:

Z1c-Linker          (Formula II)

wherein the Z1c-Linker is selected from Formulae FFL-1 to FFL-101;
wherein X is selected from a leaving group (e.g., halogen, a N-hydroxysuccinimide (NHS) group, a 2,3,5,6-tetrafluorophenol (TFP) group, a pentafluorophenol (Pfp) group, or a sulfonate ester), $NH_2$, OH, and H; and
wherein $B_1$ and $B_2$, which may be identical or different, each independently represents an aromatic boron-containing group.

In some embodiments of the compound of Formula I, X1 comprises an insulin receptor agonist that is insulin or an insulin analogue having an A-chain and a B-chain. In some embodiments, one or more lysine residues and/or the N-terminus of the A- or B-chain are covalently conjugated as described by Formula I. In some embodiments the insulins or insulin analogues described herein are used as compounds (e.g., intermediate compounds) for the manufacture of conjugates described by Formula I. In some embodiments, the insulins or insulin analogues described herein are used in methods for preventing and/or treating an endocrine and/or metabolic disease, for example comprising administering any compound (e.g., modified insulin) of the embodiments described herein to a subject in need thereof, thereby treating the endocrine and/or metabolic disease.

DETAILED DESCRIPTION OF THE DISCLOSURE

While aromatic boron-containing compounds (e.g., groups) can bind to diol containing molecules, achieving selectivity using aromatic boron-containing compounds (which can act as molecular sensors) is challenging because of their ability to bind various diols, including cis diols, to varying degrees. Improved binding affinity of aromatic boron-containing compounds (which can act as sensors) towards a specific vicinal diol of interest may result in a loss of selectivity.

Scaffolds that position the boron functionality (e.g., sensor) of the aromatic boron-containing compounds in a specific or particular ensemble of geometries can increase selectivity towards a specific vicinal diol while simultaneously maintaining affinity for the diol of interest. According to some embodiments, aromatic boron-containing compounds disclosed herein have different pendant groups on the aromatic boron-based scaffolds along with specific scaffold geometries that impact binding to hydroxyl containing molecules.

According to some embodiments, the compounds of the present disclosure comprise aromatic boron-containing compounds that orient the boron functionalities in three dimensional space, so that the boron-containing compounds are spatially oriented to engage hexoses containing vicinal diols, such that the boron groups can appropriately engage the hydroxyls in the vicinal diol molecule and provide enhancement of selectivity. In some embodiments, the aromatic boron-containing compounds are modified with specific functional groups on the aromatic ring that, together with an appropriate or suitable scaffold, may provide higher selectivity and/or affinity for binding towards a vicinal diol of interest and away from other diols in the body.

In some embodiments, the aromatic boron-containing compounds are conjugated to a drug substance (e.g., small-molecule, polypeptide) wherein the aromatic boron-containing compounds provide intramolecular and/or intermolecular interactions with the drug substance and/or with proteins in the body, such as circulating proteins in the blood and/or plasma including albumin and/or globulins. In some embodiments, aromatic boron-containing compounds exhibit reversible binding to glycated proteins in the body, such as glycated albumin, and this binding is reversibly influenced by the levels of blood sugar or plasma sugar molecules. In some embodiments, the selective binding of the sensors to specific vicinal diols changes the extent of those intramolecular and/or intermolecular bindings and thereby modulates the pharmacokinetics and overall activity of the drug substance in the body; this effect can be controlled by the level of the vicinal diols present.

In some embodiments, the drug substance is a peptide hormone. In some embodiments, the peptide hormone is a human peptide hormone such as insulin or an insulin analogue, glucagon, or another incretin hormone. In some embodiments the sensors are selective towards the vicinal diols in glucose, and this selectivity is enhanced while maintaining affinity to glucose and simultaneously reducing affinity to other sugars in the blood. In some embodiments, the scaffolds as well as (e.g., in combination with) the pendant groups on the aromatic core of the boron-containing compounds enable controlling the overall activity and/or pharmacokinetics of the conjugated drug substances based on levels of glucose and/or other vicinal diols in the blood.

In some embodiments, the aromatic boron-containing compounds comprise specific scaffold molecules (e.g., FF structures, FFL-1 to FFL-101, DSL-1 (Diboronate Scaffold Linker) to DSL-112) with conjugated boron functionalities (i.e., F2, F5, and F10), wherein the scaffolds have been used to orient the boron functionalities in three dimensional geometries so that the boron functionalities are oriented near each other and within a distance that helps engage specific hydroxyl orientations of select hexoses such as glucose.

Without wishing to be bound by theory, it is believed that the aromatic boron-containing compounds (e.g., molecules) disclosed herein enhance selectivity through at least one or more of the following three mechanisms: (1) the FF scaffold facilitates matching the orientation of the hydroxyl and/or alkoxy groups on boron groups in the aromatic boron-containing compounds and the hydroxyls in the vicinal diol molecule which enhances selectivity; (2) further selectivity gain is obtained by identifying specific functional groups attached to, or near, for example, the aromatic core of the boron-containing compound which impact the electronic structure of the aromatic boron-containing compound and thereby favor reversible binding to the vicinal diols at physiological pH; and (3) functional groups attached to the aromatic boron-containing compound (e.g., the sensor scaffold) help to provide steric hindrance to reduce binding to unwanted hexoses while maintaining binding to the sugar of interest such as glucose. In some embodiments, the FF scaffolds provide glucose binding. In some embodiments, the combination of the FF scaffold and the indirect linker provides affinity to plasma proteins, such as but not limited to glycated proteins, and the combination of the FF scaffold and the indirect linker provides a reversible interaction with plasma proteins that is controlled through the binding of sugar molecules to the FF scaffolds under physiological conditions. These effects as combined together (e.g., compounds of Formula I and II) in the present disclosure provide desired or suitable selectivity of binding towards a vicinal diol-containing molecule of interest and away from other diols in the body.

In some embodiments, the aromatic boron-containing compounds are conjugated to a drug substance wherein the aromatic boron-containing compounds provide intramolecular and/or intermolecular interactions with proteins in the body. Such proteins may include circulating proteins in the blood and/or human plasma such as albumin, glycosylated proteins and/or immunoglobulins, glycated proteins including glycated plasma proteins such as glycated albumin. In some embodiments the selective binding of the sensors to specific vicinal diols in a molecule of interest changes the extent of intramolecular and intermolecular bindings and thereby modulates the pharmacokinetics and overall activity of the drug substance in the body. In some embodiments, the drug substance is a peptide hormone and in certain embodiments thereof the peptide hormone is an incretin hormone such as insulin and the vicinal diol containing molecule is glucose, but the present disclosure is not limited thereto.

Definitions

Unless otherwise defined, all terms (including technical and scientific terms) used herein have the same meaning as commonly understood by one of ordinary skill in the art to which the present disclosure belongs. It will be further understood that terms, such as those defined in commonly used dictionaries, should be interpreted as having a meaning that is consistent with their meaning in the context of the relevant art and/or the present specification, and should not be interpreted in an idealized or overly formal sense, unless expressly so defined herein.

Unless specifically described herein, functional groups, functional moieties, and reactions referred to herein are understood to have meanings consistent with standard descriptions in and/or general principles of organic chemistry, for example, as described in Organic Chemistry, Thomas Sorrell, University Science Books, Sausalito, 1999; Larock, Comprehensive Organic Transformations, VCH Publishers, Inc., New York, 1989; Carruthers, Some Modern Methods of Organic Synthesis, $3^{rd}$ Edition, Cambridge University Press, Cambridge, 1987; Smith and March, March's Advanced Organic Chemistry, $5^{th}$ Edition, John Wiley & Sons, Inc., New York, 2001. Generic functional groups (such as alkyl, aryl, acetyl, etc.) encompass specific examples or species falling within those functional group categories as generally defined in the field of organic chemistry, and those having ordinary skill in the art are capable of identifying specific example embodiments of functional groups.

Unless specifically described herein, chemical terms, functional groups, and general terms used throughout the specification are identified in accordance with the Periodic Table of the Elements, CAS version, Handbook of Chemistry and Physics, 75$^{th}$ Ed., inside cover. In certain embodiments, the terms "a," "an," and "the" and similar referents used herein are to be construed to cover both the singular and the plural unless their usage in context indicates otherwise. The term "CAS #" as used herein is also referred to as CASRN or CAS Number, is a unique numerical identifier assigned by Chemical Abstracts Service (CAS) to every chemical substance described in the open scientific literature.

As used herein, nomenclature for compounds including organic compounds, can be given using common names, IUPAC, IUBMB, or CAS recommendations for nomenclature. One of skill in the art can readily ascertain the structure of a compound if given a name, either by systemic reduction of compound structure using naming conventions, or by commercially available software, such as CHEMDRAW™ (Cambridgesoft Corporation, U.S.A.).

The terminology used herein is for the purpose of describing embodiments and is not intended to be limiting of the present disclosure. It will be further understood that the terms "comprises," "comprising," "includes," and "including," when used in this specification, specify the presence of the stated features, integers, acts, operations, elements, and/or components, but do not preclude the presence or addition of one or more other features, integers, acts, operations, elements, components, and/or groups thereof. As used herein, the term "and/or" includes any and all combinations of one or more of the associated listed items. Expressions such as "at least one of," when preceding a list of elements, modify the entire list of elements and do not modify the individual elements of the list.

As used herein, the terms "substantially," "about," and similar terms are used as terms of approximation and not as terms of degree, and are intended to account for the inherent deviations in measured or calculated values that would be recognized by those of ordinary skill in the art. The term "about" used throughout is used to describe and account for small variations. For instance, "about" may mean the numeric value may be modified by ±5%, ±4%, ±3%, ±2%, ±1%, ±0.5%, ±0.4%, ±0.3%, ±0.2%, ±0.1% or ±0.05%. Numeric values modified by the term "about" include the specific identified value. For example, "about 5.0" includes 5.0.

Further, the use of "may" when describing embodiments of the present disclosure refers to "one or more embodiments of the present disclosure." As used herein, the terms "use," "using," and "used" may be considered synonymous with the terms "utilize," "utilizing," and "utilized," respectively. Also, the term "exemplary" is intended to refer to an example or illustration.

Also, any numerical range recited herein is intended to include all sub-ranges of the same numerical precision subsumed within the recited range. For example, a range of "1 to 10" is intended to include all subranges between (and including) the recited minimum value of 1 and the recited maximum value of 10, that is, having a minimum value equal to or greater than 1 and a maximum value equal to or less than 10, such as, for example, 2 to 7. Any maximum numerical limitation recited herein is intended to include all lower numerical limitations subsumed therein, and any minimum numerical limitation recited in this specification is intended to include all higher numerical limitations subsumed therein. Accordingly, Applicant reserves the right to amend this specification, including the claims, to expressly recite any sub-range subsumed within the ranges expressly recited herein.

As used herein, "aromatic boron-containing group" refers to a compound having at least one boron atom covalently bonded to an aromatic group and/or a compound having at least one boron atom covalently incorporated within an aromatic group. The term "aromatic" as used herein may include "heterocycle," "heterocyclyl," or "heterocyclic." As used herein the terms "heterocycle," "heterocyclyl," or "heterocyclic" each refer to an unsaturated 3- to 18-membered ring containing one, two, three, or four heteroatoms independently selected from nitrogen, oxygen, phosphorus, and sulfur. In some embodiments, the term "aromatic" may include an "aryl." The term "aryl" as used herein refers to a mono-, bi-, or other multi carbocyclic, aromatic ring system with 5 to 14 ring atoms. The aryl group can optionally be fused to one or more rings selected from aryls, cycloalkyls, heteroaryls, and heterocyclyls. Exemplary aryl groups also include but are not limited to a monocyclic aromatic ring system, wherein the ring comprises 6 carbon atoms.

The term "heteroaryl" as used herein refers to a mono-, bi-, or multi-cyclic, aromatic ring system containing one or more heteroatoms, for example 1-3 heteroatoms, such as nitrogen, oxygen, and sulfur. Heteroaryls can be substituted with one or more substituents. Heteroaryls can also be fused to non-aromatic rings. Exemplary heteroaryl groups include, but are not limited to, a monocyclic aromatic ring, wherein the ring comprises 2-5 carbon atoms and 1-3 heteroatoms. In some embodiments, the aromatic boron-containing group may include but is not limited to aryl- and heteroaryl boronic acids, aryl and heteroaryl boronate esters, and/or boroxoles. Exemplary aromatic boron-containing groups useful according to certain embodiments, include, e.g., those described herein as FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, FF226, F2, F5, F10, and FFL-1 to FFL-101, and further include, e.g., those as disclosed in patent application PCT/US2021/025261 (filed Mar. 31, 2021) as compounds F1-F9, F12-F43, F500-F520 and PCT/US2021/059802 (filed Nov. 18, 2021) as compounds FF1-FF224 and F1-F10; the disclosures of which are herein expressly incorporated by reference in their entirety.

The term "small-molecule linker" as used herein refers to a chemical group (e.g., scaffold, moiety) comprising a first attachment point toward X1 and a second attachment point toward Z1b, Z1a, or Z1c. In some embodiments, the first attachment point is toward X1 and the second attachment point is toward Z1c. In some embodiments, the first attachment point is toward X1 and the second attachment point is toward Z1a. In some embodiments, the small molecule linker is a moiety/chemical group selected from Formulae IIa-IIai, Formulae IIIa-IIIai, and FL1-FL19 disclosed in patent application PCT/US2021/025261, the relevant disclosure of which is expressly incorporated herein by reference.

The term "indirect linker" as used herein refers to a chemical group (e.g., scaffold, moiety) comprising a first attachment point toward X1 and a second attachment point toward Z1b, Z1a, or Z1c. In some embodiments, the first attachment point is toward X1 and the second attachment point is toward Z1c. In some embodiments, the indirect linker is a moiety/chemical group selected from Formulae (i) FL3, FL5, FL5A, FL5B, and FL20-FL75, stereoisomers thereof; and (ii) an L- or D-natural or unnatural amino acid. In some embodiments, at least one Z1c is covalently conjugated via one or more indirect linkers to X1 or to Z1a, wherein the indirect linker is represented by Formula $(X'')_{n1}$, and each n1 is independently selected from 1, 2, 3, 4, and 5. For example, at least one Z1c is covalently conjugated via the indirect linker to X1, wherein the indirect linker is represented by Formula III:

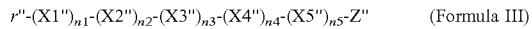 (Formula III)

wherein
z" represents an attachment point to an amine in X1;
r" represents an attachment point to Z1c;
each of n1, n2, n3, n4 and n5 is independently 0 or 1;
each X1", X2", X3", X4", X5" is independently selected from an L- or D-amino acid, wherein the amine functional group of the amino acid is covalently conjugated towards r" in Formula III, and the acid functional group of the amino acid is covalently conjugated towards z" in Formula III, FL3, FL5, FL5A, FL5B, and FL20-FL75.

As used herein, "amino acid" includes proteinogenic (or natural) amino acids (amongst those the 20 standard amino acids), as well as non-proteinogenic (or non-natural) amino acids. Proteinogenic amino acids are those which are naturally incorporated into proteins. The standard amino acids are those encoded by the genetic code. Non-proteinogenic amino acids are either not found in proteins, or not produced by standard cellular machinery (e.g., they may have been subject to post-translational modification). In general, amino acid residues (peptide/protein sequences) may be identified by their full name, their one-letter code, and/or their three-letter code. These three ways are fully equivalent. In what follows, each amino acid of the compounds of the disclosure for which the optical isomer is not stated is to be understood to mean the L-isomer (unless otherwise specified). Amino acids are molecules containing an amino group and a carboxylic acid group, and, optionally, one or more additional groups, often referred to as a side chain.

As used herein, the term "amino acid residue" is an amino acid from which, formally, a hydroxy group has been removed from a carboxy group and/or from which, formally, a hydrogen atom has been removed from an amino group. As is apparent from the below examples, amino acid residues may be identified by their full name, their one-letter code, and/or their three-letter code. These three ways are fully equivalent and interchangeable.

The term "alkyl" as used herein refers to a saturated straight or branched hydrocarbon, such as a straight or branched group of 1-30 carbon atoms, referred to herein as $C_{1-30}$ alkyl. In some embodiments, the alkyl group is a $C_1$-$C_{22}$ alkyl group. In some embodiments, the alkyl group is a $C_1$-$C_{20}$ alkyl group. In some embodiments, the alkyl group is a $C_1$-$C_{18}$ alkyl group. In some embodiments, the alkyl group is a $C_1$-$C_{16}$ alkyl group. In some embodiments, the alkyl group is a $C_1$-$C_{14}$ alkyl group. In some embodiments, the alkyl group is a $C_1$-$C_{12}$ alkyl group. In some embodiments, the alkyl group is a $C_1$-$C_{10}$ alkyl group. In some embodiments, the alkyl group is a $C_1$-$C_8$ alkyl group. In some embodiments, the alkyl group is a $C_1$-$C_6$ alkyl group. In some embodiments, the alkyl group is a $C_1$-$C_4$ alkyl group. Exemplary alkyl groups include, but are not limited to, methyl, ethyl, propyl, isopropyl, 2-methyl-1-propyl, 2-methyl-2-propyl, 2-methyl-1-butyl, 3-methyl-1-butyl, 2-methyl-3-butyl, 2,2-dimethyl-1-propyl, 2-methyl-1-pentyl, 3-methyl-1-pentyl, 4-methyl-1-pentyl, 2-methyl-2-pentyl, 3-methyl-2-pentyl, 4-methyl-2-pentyl, 2,2-dimethyl-1-butyl, 3,3-dimethyl-1-butyl, 2-ethyl-1-butyl, butyl, isobutyl, t-butyl, pentyl, isopentyl, neopentyl, hexyl, heptyl, and octyl. In some embodiments, "alkyl" is a straight-chain hydrocarbon. In some embodiments, "alkyl" is a branched hydrocarbon.

The term "cycloalkyl" as used herein refers to a saturated or unsaturated cyclic, bicyclic, or bridged bicyclic hydrocarbon group of 3-16 carbons, or 3-8 carbons, referred to herein as "$(C_3$-$C_8)$cycloalkyl," derived from a cycloalkane. In some embodiments, the cycloalkyl is a $(C_3$-$C_6)$cycloalkyl. Exemplary cycloalkyl groups include, but are not limited to, cyclohexanes, cyclohexenes, cyclopentanes, and cyclopentenes. Cycloalkyl groups may be substituted with alkoxy, aryloxy, alkyl, alkenyl, alkynyl, amide, amino, aryl, arylalkyl, carbamate, carboxy, cyano, cycloalkyl, ester, ether, formyl, halogen, haloalkyl, heteroaryl, heterocyclyl, hydroxyl, ketone, nitro, phosphate, sulfide, sulfinyl, sulfonyl, sulfonic acid, sulfonamide and thioketone. Cycloalkyl groups can be fused to other cycloalkyl (saturated or partially unsaturated), aryl, or heterocyclyl groups, to form a bicycle, tetracycle, etc. The term "cycloalkyl" also includes bridged and spiro-fused cyclic structures which may or may not contain heteroatoms.

The term "acyl" as used herein refers to R—C(O)— groups such as, but not limited to, (alkyl)-C(O)—, (alkenyl)-C(O)—, (alkynyl)-C(O)—, (aryl)-C(O)—, (cycloalkyl)-C(O)—, (heteroaryl)-C(O)—, and (heterocyclyl)-C(O)—, wherein the group is attached to the parent molecular structure through the carbonyl functionality. In some embodiments, it is a $C_{1-10}$ acyl radical which refers to the total number of chain or ring atoms of the, for example, alkyl, alkenyl, alkynyl, aryl, cycloalkyl, or heteroaryl, portion plus the carbonyl carbon of acyl. For example, a $C_4$-acyl has three other ring or chain atoms plus carbonyl. In some embodiments, it is a $C_1$-$C_{22}$acyl group. In some embodiments, it is a $C_1$-$C_{20}$ acyl group. In some embodiments, it is a $C_1$-$C_{18}$acyl group. In some embodiments, it is a $C_1$-$C_{16}$acyl group. In some embodiments, it is a $C_1$-$C_{14}$acyl group. In some embodiments, it is a $C_1$-$C_{12}$acyl group. In some embodiments, it is a $C_1$-$C_{10}$acyl group. In some embodiments, it is a $C_1$-$C_8$acyl group.

The term "haloalkyl" as used herein refers to an alkyl group substituted with one or more halogens. Examples of haloalkyl groups include, but are not limited to, trifluoromethyl, difluoromethyl, pentafluoroethyl, trichloromethyl, etc. In some embodiments, it is a $C_1$-$C_{22}$ haloalkyl group. In some embodiments, it is a $C_1$-$C_{20}$ haloalkyl group. In some embodiments, it is a $C_1$-$C_{15}$ haloalkyl group. In some embodiments, it is a $C_1$-$C_{16}$ haloalkyl group. In some embodiments, it is a $C_1$-$C_{14}$ haloalkyl group. In some embodiments, it is a $C_1$-$C_{12}$ haloalkyl group. In some embodiments, it is a $C_1$-$C_{10}$ haloalkyl group. In some embodiments, it is a $C_1$-$C_8$ haloalkyl group.

The term "aryl" as used herein refers to a mono-, bi-, or other multi-carbocyclic, aromatic ring system with 5 to 14 ring atoms. The aryl group can optionally be fused to one or more rings selected from aryls, cycloalkyls, heteroaryls, and heterocyclyls. The aryl groups of this present disclosure can be substituted with groups selected from alkoxy, aryloxy, alkyl, alkenyl, alkynyl, amide, amino, aryl, arylalkyl, carbamate, carboxy, cyano, cycloalkyl, ester, ether, formyl, halogen, haloalkyl, heteroaryl, heterocyclyl, hydroxyl, ketone, nitro, phosphate, sulfide, sulfinyl, sulfonyl, sulfonic acid, sulfonamide, and thioketone. Exemplary aryl groups include, but are not limited to, phenyl, tolyl, anthracenyl, fluorenyl, indenyl, azulenyl, and naphthyl, as well as benzo-fused carbocyclic moieties such as 5,6,7,8-tetrahydronaphthyl. Exemplary aryl groups also include but are not limited to a monocyclic aromatic ring system, wherein the ring comprises 6 carbon atoms.

As used herein, a "leaving group" is an atom (or a group of atoms) that can be displaced as stable species taking with it the bonding electrons. For example, leaving groups can be anions (e.g. Cl$^-$) or neutral molecules (e.g. H$_2$O). In some embodiments, a leaving group is a halogen, a N-hydroxysuccinimide (NHS) group, a 2,3,5,6-tetrafluorophenol (TFP) group, a pentafluorophenol (Pfp) group, or a sulfonate ester.

"Isomers" means compounds having the same number and kind of atoms, and hence the same molecular weight, but differing with respect to the arrangement or configuration of the atoms in space.

"Stereoisomer" or "optical isomer" means a stable isomer that has at least one chiral atom or restricted rotation giving rise to perpendicular dissymmetric planes (e.g., certain biphenyls, allenes, and spiro compounds) and can rotate plane-polarized light. Because asymmetric centers and other chemical structure exist in the compounds of the disclosure which may give rise to stereoisomerism, the disclosure contemplates stereoisomers and mixtures thereof. The compounds of the disclosure and their salts include asymmetric carbon atoms and may therefore exist as single stereoisomers, racemates, and as mixtures of enantiomers and diastereomers. In some embodiments, such compounds will be prepared as a racemic mixture. In some embodiments, such compounds can be prepared or isolated as pure stereoisomers, e.g., as individual enantiomers or diastereomers, or as stereoisomer-enriched mixtures. As discussed in more detail below, individual stereoisomers of compounds may be prepared by synthesis from optically active starting materials containing the desired chiral centers or by preparation of mixtures of enantiomeric products followed by separation or resolution, such as conversion to a mixture of diastereomers followed by separation or recrystallization, chromatographic techniques, use of chiral resolving agents, or direct separation of the enantiomers on chiral chromatographic columns. Starting compounds of particular stereochemistry are either commercially available or are made by the methods described below and resolved by techniques well-known in the art.

As used herein, a "fatty acid" is a carboxylic acid with an aliphatic chain. A saturated fatty acid has a saturated aliphatic chain whereas an unsaturated fatty acid has an unsaturated aliphatic chain. In some embodiments, the fatty acid is a $C_3$-$C_{26}$ fatty acid. In some embodiments, the fatty acid is a $C_4$-$C_{20}$ fatty acid. In some embodiments, the fatty acid is a saturated fatty acid selected from $CH_3CH_2COOH$, $CH_3(CH_2)_2COOH$, $CH_3(CH_2)_3COOH$, $CH_3(CH_2)_4COOH$, $CH_3(CH_2)_5COOH$, $CH_3(CH_2)_6COOH$, $CH_3(CH_2)_7COOH$, $CH_3(CH_2)_8COOH$, $CH_3(CH_2)_9COOH$, $CH_3(CH_2)_{10}COOH$, $CH_3(CH_2)_{11}COOH$, and $CH_3(CH_2)_{12}COOH$, $CH_3(CH_2)_{13}COOH$, $CH_3(CH_2)_{14}COOH$, $CH_3(CH_2)_{15}COOH$, $CH_3(CH_2)_{16}COOH$, $CH_3(CH_2)_{17}COOH$, and $CH_3(CH_2)_{18}COOH$. In some embodiments, the fatty acid is an unsaturated fatty acid selected from α-linoleic acid, stearidonic acid, eicosapentaenoic acid, cervonic acid, linoleic acid, linolelaidic acid, γ-Linolenic acid, oleic acid, elaidic acid, and gondoic acid.

The term "pharmaceutically acceptable salt(s)" refers to salts of acidic or basic groups that may be present in compounds used in the present compositions.

As used herein, "drug substance" refers to small-molecule compounds and/or polypeptide containing compounds. According to some embodiments, a drug substance suitable for use in the compounds and methods described herein is a therapeutically, prophylactically and/or diagnostically active drug substance.

It will be understood that, although terms such as "first," "second," "third," etc., may be used herein to describe various elements (such as molecules, components, groups, and/or moieties, etc.), those elements should not be limited by these terms. These terms are merely used to distinguish one element from another element. Thus, a first element described below could be termed a second element without departing from the spirit and scope of the present disclosure. It will be understood that when an element or group is referred to as being "connected to," "conjugated with," "linked," or "coupled to" another element or group, the two elements may be directly connected, or one or more intervening elements may be present. It will be understood that conjugations and linkages described herein have the option of being direct conjugations or direct linkages, unless expressly excluded or precluded by the context.

As used herein, the terms "directly" or "directly covalently conjugated" or "covalently conjugated directly" may be interchangeably used to indicate that a first group is "directly" or "directly covalently conjugated" or "covalently conjugated directly" to a second group, which means the first and second groups are covalently bonded together without additional intervening groups.

As used herein, the terms "indirectly" or "indirectly covalently conjugated" or "covalently conjugated indirectly" may be interchangeably used to indicate that a first group is "indirectly" or "indirectly covalently conjugated" or "covalently conjugated indirectly" to a second group, which means the first and second groups are covalently bonded together with at least one additional intervening group (e.g., a small-molecule, a linker, a spacer, a linear sequence of amino acids and/or nonlinear sequence of amino acids).

The terms "insulin receptor agonist," "compound having agonist potency" in the context of having potency against an insulin receptor, and "agonist potency" in the context of a compound having agonist potency against an insulin receptor refer to a compound (e.g., a compound of Formula (I), a protein, a fusion protein as described in, e.g., US 2016/0324932) that binds to and/or activates an insulin receptor.

The term "short-acting insulin receptor agonist" and "short-acting insulin" refer to an insulin receptor agonist having an onset of activity equal to or faster than insulin isophane human and insulin human, sold under the tradename Humulin®. For example, a short-acting of insulin may have an onset of action that occurs within 10 minutes of injection. As another example, a short-acting of insulin may have an onset of action that occurs within 20 minutes of injection. In some embodiments, a short-acting insulin may have a maximum effectiveness (peak) within 1-4 hours post injection. In some embodiments, short-acting insulin can be administered before or during and/or shortly after a meal.

The term "long-acting insulin receptor agonist" and "long-acting insulin" refer to an insulin receptor agonist having an onset of action slower than Humulin®. For example, a long-acting insulin may have an onset of action between 1-2 hours, or longer. In certain embodiments, a long-acting insulin may have a maximum effectiveness (peak) within between 6-20 hours and or have prolonged action. In some embodiments, a long-acting insulin can be administered at a frequency of once daily or, for example, once weekly.

When used herein in connection with an insulin receptor agonist, the term "suitable for meal dosing" refers to a short acting insulin receptor agonist suitable for controlling blood glucose levels during and/or shortly after a meal.

When used herein in connection with an insulin receptor agonist, the term "suitable for once-weekly dosing" refers to an insulin receptor agonist with a pharmacokinetic and pharmacodynamic profile that is sufficiently prolonged to control blood glucose levels throughout the day when administered no more frequently than once weekly. Examples of such molecules include fusion proteins as described in US2016/0324932, including BIF. BIF, also known as insulin efsitora alfa, comprises a dimer of an insulin receptor agonist fused to a human IgG Fc region, wherein the insulin receptor agonist comprises an insulin B-chain analogue fused to an insulin A-chain analogue through the use of a first peptide linker and wherein the C-terminal residue of the insulin A-chain analogue is directly fused to the N-terminal residue of a second peptide linker, and the C-terminal residue of the second peptide linker is directly fused to the N-terminal residue of the human IgG Fc region. BIF is identified by CAS registry number 2131038-11-2, which provides the following chemical names: (1) Insulin [16-glutamic acid, 25-histidine, 27-glycine, 28-glycine, 29-glycine, 30-glycine] (human B-chain) fusion protein with peptide (synthetic 7-amino acid linker) fusion protein with insulin [47-threonine, 51-aspartic acid, 58-glycine] (human A-chain) fusion protein with peptide (synthetic 20-amino acid linker) fusion protein with immunoglobulin G2 (human Fc fragment), dimer; and (2) *Homo sapiens* Insulin B-chain [Y16>Y(16), F25>H(25), TPKT27-30>GGGG(27-30)] (1-30) fusion protein with di glycyl seryltetraglycyl (31-37) Insulin A-chain [I10>T(47), Y14>D(51), N21>G(58)](38-58) fusion protein with tris (tetraglycylglutaminyl)pentaglycyl (59-78) *Homo sapiens* Immunoglobulin heavy constant gamma 2 {del-CH1, hinge-(7-12), CH2, CH3[$K^{107}$>del(300)]}(79-299), dimer (80-80': 83-83')-bisdisulfide, expressed in CHO cells, alfa glycosylated.

As used herein, "glucose sensing insulin" refers to an insulin receptor agonist having an onset of activity and/or level of activity that depends on blood sugar level. Examples of such molecules include compounds of Formula (I) disclosed herein, such as Examples 2, 5, 13, 22, 28, 32, 35, 50, 56, 90, 91, 92, 93, 94, 95, 96, 97, 98, 99, 126, 128, 132, 134, 135, 150, and 154.

The term "incretin-based therapy" includes any treatment which comprises administration of, or promotes, enables, enhances and/or simulates the effects of, a group of metabolic hormones known as incretins, which group includes, but is not limited to, GLP-1, gastric inhibitory peptide (GIP), and glucagon. Incretin-based therapies which are currently available include GLP-1R agonists.

A "DPP-4 inhibitor" is a compound that blocks the DPP-4 enzyme, which is responsible for the degradation of incretins. Currently available DPP-4 inhibitors include sitagliptin (Januvia®) and linagliptin (Tradjenta®).

A "GLP-1R agonist" and "Glucagon receptor agonist" is defined as a compound comprising the amino acid sequence of native human GLP-1 (SEQ ID NO:25) or human glucagon, as well as a compound that maintains full or partial activity at the GLP-1 receptor that is a GLP-1 analogue, GLP-1 derivative or GLP-1 fusion protein. GLP-1R activity may be measured by methods known in the art, including using in vivo experiments and in vitro assays that measure GLP-1 receptor binding activity or receptor activation, e.g., assays employing pancreatic islet cells or insulinoma cells, as described in EP 619,322 and U.S. Pat. No. 5,120,712, respectively. A GLP-1 analogue is a molecule having a modification including one or more amino acid substitutions, deletions, inversions, or additions when compared with the amino acid sequence of native human GLP-1 (SEQ ID NO:25). A GLP-1 derivative is a molecule having the amino acid sequence of native human GLP-1 (SEQ ID NO:25) or of a GLP-1 analogue, but additionally having at least one chemical modification of one or more of its amino acid side groups, α-carbon atoms, terminal amino group, or terminal carboxylic acid group. A GLP-1 fusion protein is a heterologous protein comprising GLP-1, a GLP-1 analogue or a GLP-1 derivative portion and a second polypeptide. Currently available GLP-1R agonists include exenatide (Byetta® and Bydureon®), liraglutide (Victoza®), albiglutide (Tanzeum®) and dulaglutide (Trulicity®), the structures of which are known in the art. See, e.g., U.S. Pat. No. 5,424,286 (exenatide); U.S. Pat. No. 6,268,343 (liraglutide); US 20140447 I 7 (albiglutide); and U.S. Pat. No. 7,452,966 (dulaglutide).

The term "excipient" means any substance added to the composition other than the fusion protein or any other additional active ingredient(s). Examples of such excipients that may be used in the compositions of the present invention include buffering agents, surfactants, isotonicity agents and preservatives. A "pharmaceutically acceptable excipient" refers to an excipient that is compatible with the other ingredients in the composition and that is suitable for contact with any tissue, organ, or portion of the body that it may encounter, meaning that it must not carry a risk of toxicity, irritation, allergic response, immunogenicity, or any other complication that excessively outweighs its therapeutic benefits. In some embodiments the excipients may be used to stabilize the agonist while in solution or to increase the onset and maximum effectiveness. Such excipients may include mannitol, sorbitol, m-cresol, EDTA, and citrate.

A "buffering agent" is a substance which resists changes in pH by the action of its acid-base conjugate components. In certain embodiments, the composition of the present invention has a pH from about 5.5 to about 9.0, preferably, between about 7.0 and about 8.0, more preferably between about 7.2 and 7.8. Buffering agents suitable for controlling the pH of the compositions of the present invention in the desired range include, but are not limited to agents such as phosphate, acetate, citrate, or acids thereof, arginine, TRIS, HEPES, and histidine buffers, as well as combinations thereof. "TRIS" refers to 2-amino-2-hydroxymethyl-1,3,-propanediol, and to any pharmacologically acceptable salt thereof. The free base and the hydrochloride form (i.e., TRIS-HCl) are two common forms of TRIS. TRIS is also known in the art as trimethylol aminomethane, tromethamine, and tris(hydroxymethyl) aminomethane. Preferred buffering agents in the composition of the present invention are citrate, or citric acid, phosphate, and TRIS.

The compounds disclosed herein may comprise one or more protein components (e.g., where X1 comprises one or more protein components). In some embodiments, the compounds disclosed herein comprise two or more fused protein components or two or more conjugated protein components. The term "fusion protein" as used herein refers to the combination of two or more distinct proteins that are linked together directly via a peptide bond between the C-terminus of one protein and the N-terminus of another protein or indirectly via a linker (i.e., through chemical linkers such as biofunctionalized PEG linkers) or through a continuous amino acid chain) joining the C-terminus or the N-terminus or a side chain of one protein and the C-terminus or the N-terminus or a side chain of another protein. The term "conjugate protein" as used herein refers to the combination of two or more distinct proteins that are linked together chemically either directly via a chemical bond or indirectly via a chemical linker. In some instances, the two or more proteins may act on the same or similar receptors (i.e., a fusion of two insulin agonist peptides) or may act upon separate and distinct receptors (i.e., one protein is an insulin receptor agonist, and another protein is a glucagon receptor agonist). In some instances, the fusion protein may contain only one agonist protein while the other protein is a human IgG Fc region or a single domain antibody (nanobody) or a variable-heavy chain sequence ($V_HH$).

The phrase "composition comprising a fusion protein" encompasses compositions comprising a monomer, homodimer, heterodimer, or multimer of a fusion protein. In certain embodiments, a pharmaceutical composition of the present disclosure is a composition comprising a fusion protein in a concentration of at least 1 mg/mL, at least 2 mg/mL, at least 5 mg/mL, at least 10 mg/mL, at least 20 mg/mL, at least 25 mg/mL, at least 30 mg/mL, at least 35 mg/mL, at least 50 mg/mL, at least 55 mg/mL, at least 50 mg/mL, at least 65 mg/mL, at least 75 mg/mL, at least 100 mg/mL or greater. In some embodiments, the fusion protein is present in a concentration of 10-100 mg/mL. In some embodiments, the fusion protein is present in a concentration of 15-75 mg/mL, and in some embodiments, the fusion protein is present in a concentration of 20-65 mg/mL.

The pharmaceutical compositions of the present disclosure may also contain a "surfactant," meaning a substance that lowers the surface tension of a liquid. Examples of surfactants used in pharmaceutical compositions and which may be used in certain compositions of the present disclosure include polysorbate 20, polysorbate 80, polyethylene glycols (e.g., PEG 400, PEG 3000, TRITON X-100), polyethylene glycol alkyl ethers (e.g., BRIJ), polypropylene glycols, block copolymers (e.g., poloxamer, PLURONIC F68; poloxamer 407, PLURONIC F127; TETRONICS), sorbitan alkyl esters (e.g., SPAN), polyethoxylated castor oil (e.g., KOLLIPHOR, CREMOPHOR), and trehalose.

The pharmaceutical compositions of the present invention may also contain a preservative. The term "preservative" refers to a compound added to a pharmaceutical formulation to act as an anti-microbial agent. Among preservatives known in the art as being effective and acceptable in parenteral formulations are benzalkonium chloride, benzethonium, chlorohexidine, phenol, m-cresol, benzyl alcohol, methyl- or propyl-paraben, chlorobutanol, o-cresol, p-cresol, chlorocresol, phenylmercuric nitrate, thimerosal, benzoic acid, and various mixtures thereof. Phenolic preservative includes the compounds phenol, m-cresol, o-cresol, p-cresol, chlorocresol, methylparaben, benzyl alcohol, and mixtures thereof. If a preservative is necessary, the preservative used in compositions of the present invention is preferably a phenolic preservative, preferably either m-cresol, phenol, and/or benzyl alcohol. Certain phenolic preservatives, such as phenol and m-cresol, are known to bind to insulin and insulin hexamers and thereby stabilize a conformational change that increases either physical or chemical stability, or both. In compositions comprising other proteins, however, such preservatives may contribute to the formation of protein aggregates, or high molecular weight polymers (HMWP). See, e.g., Maa Y F and Hsu C C, Int J Pharm 140: 155-168 (1996); Fransson J, et al., Pharm. Res., 14: 606-612 (1997); Lam X M, et al., Pharm. Res., 14: 725-729 (1997); Remmele R L Jr, et al., Pharm Res 15: 200-208. (1998); Thirumangalathu R, et al., J Pharm Sci 95: 1480-1497 (2006). In some instances, protein aggregates in therapeutic formulations can be undesirable due to their tendency to induce an immune response.

As used herein, "combination therapy" or administration "in combination with" one or more further therapeutic agents involves administration of two or more active agents (e.g., two or more pharmacological agents) intended to treat a predetermined indication and/or conditions associated therewith. The administration can be simultaneous (concurrent) or consecutive (sequential) in any order. The two or more agents of the "combination therapy" may be formulated as separate compositions (e.g., formulations) or may be formulated as a single composition (formulation). "Combination therapy" encompasses administration of agents having different mechanisms of action or targeting different indications and/or conditions as well as agents having similar mechanisms of actions or targeting similar indications and/or conditions. For example, because Type 1 diabetes patients produce little or no insulin, effective insulin therapy for Type 1 diabetics can involve the use of two types of exogenously administered insulin: a rapid-acting, mealtime insulin provided by bolus injections, and a long-acting, basal insulin, administered once or twice daily to control blood glucose levels between meals. Treatment of patients with Type 2 diabetes typically begins with prescribed weight loss, exercise, and a diabetic diet; but when these measures fail to control elevated blood sugars, then oral medications and incretin-based therapy, such as administration of glucagon-like peptide-1 (GLP-1) receptor agonists and/or dipeptidyl peptidase 4 (DPP-4) inhibitors that enable increased incretin levels, may be necessary. When these medications are still insufficient, treatment with insulin may be considered. Type 2 diabetes patients whose disease has progressed to the point that insulin therapy is required are may also be started on a single daily injection of a long-acting, basal insulin, although mealtime injections of rapid-acting insulins may be included, as necessary, in some cases. In some embodiments, the present disclosure provides a combination therapy comprising administering a rapid acting insulin and a basal insulin, and/or a fusion protein comprising, for example, one or more diboronate sensors disclosed herein.

The terms "administer," "administering," or "administration" include any method or act of delivery of a pharmacological agent (e.g., a medicament) to an intended subject (e.g., a patient). The pharmacological agent may be any suitable therapeutic agent, such as a biologic agent, such as an antibody or an antigen-binding fragment thereof (e.g., a pharmaceutical composition comprising such an antibody or antigen-binding fragment), a peptide agent (e.g., a hormone or a modified analogue thereof), or a low molecular weight agent (e.g., a structurally-defined small molecule or chemical entity). The administration of a pharmacological agent can be systemic or by local administration. In some embodiments, administration may involve one or more pharmacological agents that can be administered concurrently, simultaneously, or sequentially.

The terms "simultaneous" and "concurrently" are used interchangeably and are used herein to refer to administration of two or more therapeutic agents, where at least part of the administration overlaps in time or where the administration of second therapeutic agent falls within a short period of time, no longer than necessary to start the subsequent administration, after administration of a first therapeutic agent. For example, concurrent administration would include administering a second agent after a first agent without added delay beyond the time necessary to complete the first administration and start the second administration.

The terms "sequentially" and "consecutively" are used interchangeably and are used herein to refer to administration of two or more therapeutic agents where there is a period of delay between administering one therapeutic agent and administering another agent(s). For example, sequential administration would include administration of the two or more therapeutic agents are administered with a time separation of more than about 15 minutes, such as about any of 20, 30, 40, 50, or 60 minutes, 1 day, 2 days, 3 days, 1 week, 2 weeks, 3 weeks, or 1 month, or longer.

As used herein, the terms "basal insulin" and "basal insulins" may refer to several types of basal insulins (e.g., long-acting insulin). For example, insulin glargine, sold under the tradename LANTUS®, comprises a modified insulin structure in which the asparagine at position 21 in the insulin A-chain is replaced with glycine, and two arginines are added to the C-terminus of the B-chain. Another example, insulin glargine-algr, sold under the tradename Rezvoglar™, similarly comprises a modified insulin structure in which the asparagine at position 21 in the insulin A-chain is replaced with glycine, and two arginines are added to the C-terminus of the B-chain. As yet another example, insulin detemir, sold under the tradename LEVEMIR®, comprises a modified insulin structure in which the threonine at position 30 of the B-chain has been deleted and the lysine at position 29 of the B-chain has been derivatized through the covalent linkage of a 14-carbon, myristoyl fatty acid to the E-amine group of lysine at B29. Insulin degludec, available in Europe and Japan under the tradename TRESIBA®, comprises a modified insulin structure in which the threonine at position 30 of the B-chain has been deleted, and the F-amino group of the lysine at position 29 of the B-chain is covalently derivatized with hexadecandioic acid via a γ-L-glutamic acid linker. All of these insulins are indicated for once-daily administration. In some embodiments, the present disclosure provides the use of one or more compounds (e.g., Formula I, fusion proteins) in the manufacture of a medicament for the treatment of a disease (e.g., diabetes mellitus, obesity, dyslipidemia or metabolic syndrome), wherein the medicament is to be administered simultaneously, separately or sequentially in combination with another active ingredient. The compounds and combinations disclosed herein (e.g., compounds of Formula I, fusion proteins) are effective in treating a disease and/or condition in a subject in need thereof by administering to a patient in need thereof a therapeutically effective amount of a compound and/or composition of the present disclosure.

As used herein, the phrase "therapeutically effective amount" and "prophylactically effective amount" refer to an amount that provides a therapeutic benefit in the treatment, prevention, or management of a disease or an overt symptom of the disease. The therapeutically effective amount may treat a disease or condition, a symptom of disease, or a predisposition toward a disease, with the purpose to cure, heal, alleviate, relieve, alter, remedy, ameliorate, improve, or affect the disease, the symptoms of disease, or the predisposition toward disease. The set or specific amount that is therapeutically effective can be readily determined by an ordinary medical practitioner, and may vary depending on factors known in the art, such as, e.g. the type of disease, the patient's history and age, the stage of disease, and the administration of other therapeutic agents. In some embodiments, the phrase "therapeutically effective amount" refers to that amount of a compound and/or pharmaceutical composition and/or combination of actives disclosed herein that is sufficient to regulate blood glucose in a patient without causing unacceptable side effects. A therapeutically effective amount of the compound and/or pharmaceutical composition and/or combination of actives disclosed herein administered to a subject will depend on the type and severity of the disease and on the characteristics of the subject, such as general health, age, sex, body weight, and tolerance to drugs. The skilled artisan will be able to determine appropriate dosages depending on these and other factors. For example, a therapeutically effective amount of a fusion protein of the present disclosure when administered once weekly ranges from about 0.01 nmol/kg to about 100 nmol/kg. In some embodiments, a therapeutically effective amount of a fusion protein of the present disclosure when administered once weekly ranges from about 1 nmol/kg to about 50 nmol/kg. In some embodiments, a therapeutically effective amount of a fusion protein of the present disclosure when administered once weekly ranges from about 16 nmol/kg to about 25 nmol/kg. In some embodiments, a therapeutically effective amount of a fusion protein of the present disclosure when administered once weekly ranges from about 1 mg to about 200 mg. In some embodiments, a therapeutically effective amount of a fusion protein of the present disclosure when administered once weekly ranges from about 25 mg to about 175 mg. In some embodiments, a therapeutically effective amount of a fusion protein of the disclosure when administered once weekly ranges from about 100 mg to about 160 mg.

The terms "subject" and "patient" are herein used interchangeably and refer to a party receiving a therapy or treatment. In some embodiments, the "subject" and "patient" is a human.

The terms "blood sugar level" and "glycemia" are herein used interchangeably and refer to the concentration of sugar present in the blood. A blood sugar meter or glucometer can be used to measure the amount of sugar in a sample of blood. Blood sugar levels are generally measured as mg of sugar per dL blood (mg/dL). The blood sugar level can refer to the level of any of the sugars disclosed herein. For example, the blood sugar level would include the concentration of glucose in the blood, otherwise known as the blood glucose level/concentration.

As used herein, the term "steady state" refers to a constant/fixed condition with no increases or decreases in a variable of interest or with minimal (i.e., less than 10% or lower) variation. By way of context, in some embodiments, an insulin receptor agonist is infused intravenously (IV) in a fixed dose bolus, and blood glucose levels are maintained at some predetermined "steady state" level (e.g. 100 mg/dL for euglycemic state; 200 mg/dL or 400 mg/dL for hyperglycemic) by continuous infusion of glucose at a variable rate (mg/kg/min). The amount of glucose infused to maintain a "steady state" blood sugar level is equal to whole-body glucose uptake and utilization.

The term "hyperglycemia" is used herein to refer to physiologically high blood glucose levels. Hyperglycemic refers to a state of physiologically high blood glucose levels. Blood glucose levels that are considered hyperglycemic will vary based on the species of the subject. For example, in rats, hyperglycemia refers to a blood glucose level≥200 mg/dL. In humans, hyperglycemia refers to a blood glucose level≥180 mg/dL.

The term "euglycemia" is used herein to refer to physiologically normal blood glucose level. Euglycemic refers to a state of normal blood glucose levels. Blood glucose levels that are considered euglycemic will vary based on the species of the subject. For example, in rats, euglycemia refers to a blood glucose level<200 mg/dL. In humans, euglycemia refers to blood glucose levels of between 70-180 mg/dL.

The phrase "glucose infusion rate" is used herein to refer to the rate at which glucose is infused into a subject. The glucose infusion rate (GIR), in units of mg/kg/min, is calculated as follows: (Infusion rate (mL/hr)×Glucose concentration (g/dL)×1000 (mg/g))/Weight (kg)×60 (min/hr)× 100 (mL/dL), wherein "infusion rate" refers to the rate at which glucose is infused into the subject, "glucose concentration" refers to the concentration of glucose that is being infused, and "weight" refers to the subject's weight. In some embodiments, the GIR corresponds to the rate of glucose infusion that is required to maintain a specified blood glucose level.

The phrase "relative glucose infusion rate difference" as used herein, refers to the difference in the amount of glucose infused between two different conditions, experiments, or measurements. In some embodiments, it may be measured by taking the difference between (a) the area under the curve (AUC) for one recorded GIR for maintaining a specified blood glucose concentration and (b) the AUC for another recorded GIR for maintaining a different blood glucose concentration. Generally, the AUC for a GIR for maintaining a lower blood glucose concentration is subtracted from the AUC for a GIR for maintaining a higher blood glucose concentration. For example, where the AUC for a first GIR (providing a blood glucose concentration of 100 mg/dL) is 600 mg/kg/min·min and the AUC for a second GIR (providing a blood glucose concentration of 200 mg/dL) is 800 mg/kg/min·min, subtracting the AUC for the first GIR from the AUC for the second GIR provides a relative glucose infusion rate difference of 200 mg/kg/min·min.

As used herein, the phrase "relative glucose infusion rate ratio" refers to a ratio of the amount of glucose infused between two different conditions, experiments, or measurements. In some embodiments, it may be measured by taking the ratio between (a) the area under the curve (AUC) for one recorded GIR for maintaining a blood glucose concentration and (b) the AUC for another recorded GIR for maintaining a different glucose sugar concentration. Generally, the AUC for a GIR for maintaining a higher blood glucose concentration is divided by an AUC for a GIR for maintaining a lower blood glucose concentration. For example, where the AUC for a first GIR (providing a blood glucose concentration of 100 mg/dL) is 600 mg/kg/min·min and the AUC for a second GIR (providing a blood glucose concentration of 200 mg/dL) is 800 mg/kg/min·min, dividing the AUC for the second GIR by the AUC for the first GIR provides a relative glucose infusion rate ratio of 1.33 As used herein, the phrase "area under the curve" refers to the area bounded by a curve, the axis, and two boundary points, whether plotted or mathematically represented. In some embodiments, the curve used to calculate the area under the curve (AUC) is a measure of GIR as a function of time where the X-axis would correspond to time and the Y-axis would correspond the GIR, with the origin is at 0 on the Y-axis (i.e., the X-axis and Y-axis intersect at 0 on the Y-axis). For example, a curve may be a recorded GIR over a period of time, and the boundary points are the GIR at the start and end of the infusion in the experiment. The AUC would then be calculated for the area between the plotted curve and the X-axis, between the starting and ending boundary points. Mathematically, AUC can be calculated according to methods known to those skilled in the art, for example, as in Tai M. M. (1994) Diabetes Care, 17(2):152-154, the contents of which, are hereby incorporated by reference in its entirety. In some embodiments, area under the curve (AUC) is calculated using the trapezoid rule and with baseline correction applied. In some embodiments, the AUC is calculated using GraphPad Prism v9. For the baseline correction, an averaged GIR value from 30 minutes prior to injections (x=−30 min) to the time of injections (x=0) can be subtracted from each GIR value from time 0 (x=0) to time the last timepoint measured (x=300). The trapezoidal calculation is as follows:

$$\int_a^b f(x)dx \approx (b-a) \cdot \frac{1}{2}(f(a) + f(b)).$$

Where a is the first time point (e.g., 0 min) and b is the last time point (e.g., 300 min). The area was calculated as a subdivision of small trapezoids as follows:

$$\int_a^b f(x)dx \approx \frac{\Delta x}{2}(f(x_0) + 2f(x_1) + 2f(x_2) + 2f(x_3) + 2f(x_4) + \ldots + 2f(x_{N-1}) + f(x_N)).$$

Such that $\Delta x$ is the difference between each time point (5-minute intervals).

As used herein, the term "EC50" refers to the half maximal effective concentration of a compound in a dose-response assay. The EC50 is a measure of the concentration of a compound that is required to produce half of the maximum possible effect as a result of exposure to the compound. The EC50 can be calculated using known methods in the art. In some embodiments, the EC50 can be calculated using a four-parameter logistic regression curve using the following equation: Y=Bottom+(X^Hillslope)* (Top-Bottom)/(X^HillSlope+EC50^HillSlope), wherein hillslope refers to the slope of the sigmoidal curve between the top and bottom plateaus of the dose-response curve. In some embodiments, the EC50 may be calculated using GraphPad Prism v7, 8, or 9. When a compound has its EC50 measured at two or more concentrations of a sugar (e.g., glucose), (a) the term "a first sugar concentration" refers to the first, lower, concentration of the sugar, for example where the concentration is about 3 mM or about 5 mM, and (b) "a second sugar concentration" refers to the second, higher, concentration of the sugar, for example where the concentration is about 10 mM, about 20 mM, or about 30 mM. In some embodiments, for example, the EC50 of dose-response curves were compared to assess fold change in insulin receptor phosphorylation (IR Phosphorylation) activity of the exemplary compounds of Formula I from low (e.g., about 3 mM, or about 4 mM) to high glucose concentration (e.g., about 10 mM, about 20 mM, or about 30 mM). This fold activity change was determined by dividing the EC50 of a compound (e.g., a compound of Formula I) at "low" glucose concentration (e.g., about 3 mM) by the EC50 of that compound at "high" glucose concentration (e.g., about 20 mM), with all other conditions held constant. See Example titled "In Vitro Demonstration of Activity for Compounds of Formula I."

As used herein, the term "Kd" refers to the dissociation constant, and is reflective of the binding affinity between a ligand (e.g., a diboronate sensor as described herein) and its target (e.g., a sugar, for example, glucose). For example, "glucose Kd" and "average glucose Kd" in the context of diboronate sensors described herein refer to the affinity of the diboronate sensor for glucose where the Kd is measured before the diboronate sensor is conjugated to the insulin molecule to generate the compounds described herein. The binding of a diboronate sensor described herein to glucose may be measured through an Alizarin red S (ARS) displacement assay and is recorded prior to the diboronate sensor being conjugated (e.g., covalently bound) to the insulin molecule (e.g., compounds of Formula I). ARS displacement assays are known in the art, for example, in Springsteen and Wang (2001) Chem. Comm., 1608-1609, the content of which is incorporated by reference herein in its entirety. In the ARS displacement assay, a diboronate sensor as disclosed herein is incubated with ARS and a fluorescence emission is recorded. A composition of the diboronate sensor as described herein and ARS is then titrated against serial dilutions of a sugar (e.g., glucose), and fluorescence emission is then measured after incubation to determine displacement of ARS when the diboronate sensor binds to the sugar. The changes of intensity (fluorescence emission with and without the sugar) can be plotted against concentration of sugar to generate an associate constant for the binding of sugar. When a diboronate sensor has a higher association constant for the sugar, there is an increased Kd. Additionally, diboronate sensors as described herein include those with selective affinity/binding to sugars. For example, a diboronate sensor as described herein can include sensors having increased affinity for (binding to) glucose but not for other sugars, such as lactate and/or fructose. See Example titled "Procedure for determination of the glucose, fructose, and lactate binding (Kd) using ARS displacement assay."

As used herein the terms "clamp," "clamp assay," and "clamped" refer to hyperglycemic/euglycemic clamp (glucose clamp), which has been recognized as the "gold standard" method for detecting insulin activity via glucose utilization in experimental animals and in humans. In a hyperglycemic/euglycemic clamp, the plasma (blood) insulin concentration is acutely raised and, in certain embodiments, maintained by a continuous infusion of insulin while the plasma glucose concentration is held constant at predetermined hyperglycemic or euglycemic levels by a variable glucose infusion rate (GIR). When the steady-state blood glucose level is achieved, the glucose infusion rate equals insulin receptor-stimulated glucose uptake by all the tissues in the body and is therefore a measure of insulin activity at a specific blood glucose level. For example, in some embodiments, glucose is continuously infused to a subject over the course of a study and the glucose infusion rate is adjusted to maintain a constant blood glucose level in response to administration of a compound (e.g., a compound of Formula I). Changes in the sugar infusion rate in response to administration of a compound at a specific dose level or concentration are recorded and used to determine the sugar infusion rate. In some embodiments, the sugar is glucose. See, e.g., Lautt W. W., et al. (1998) Canadian Journal of Physiology and Pharmacology. 76(12): 1080-1086, the content of which is hereby incorporated by reference in its entirety. The clamp technique/assay referred to and used herein is a modified version of the technique known and disclosed in the art. See Example titled "In Vivo Demonstration of Activity for Compounds of Formula I."

In at least some embodiments, one or more groups (e.g., X1a, Z1a, Z1c) are covalently conjugated directly or indirectly (e.g., via indirect linker(s)) to each other. For example, according to certain embodiments Z1c is covalently conjugated, directly or indirectly (e.g., via one or more indirect linkers), to an amine in X1. As another example, according to certain embodiments one or more drug substances (X1) are covalently conjugated to one or more amine containing linkers. In some embodiments, X represents a point of covalent attachment either directly to an amine in X1 or to an amine that is covalently conjugated directly or indirectly (e.g., via the indirect linker(s)) to X1. In certain embodiments, each Z1c is independently covalently conjugated, directly or indirectly (e.g., via the indirect linker(s) of Formula $(X'')_{n1}$), to an amine of Z1a or to an amine of X1. In some embodiments, at least one Z1c is covalently conjugated via the indirect linker (e.g., Formula $(X'')_{n1}$) to X1 or to Z1a.

As used herein, terms such as "attachment point toward [group]," "attachment to," and "covalent linkage toward [group]" express that the indicated atom, attachment, or linkage is closer to the indicated group than the other attachment point or covalent linkage variables within the structure formula. In some embodiments, an attachment point or covalent linkage may be directly adjacent to the indicated group, and in some embodiments other atoms or groups may be present therebetween.

As used herein, the term "percentage homology" refers to the percentage of sequence identity between two sequences after optimal alignment. Identical sequences have a percentage homology of 100%. Optimal alignment may be performed by homology alignment algorithms described by the search for similarity method of Pearson and Lipman, *Proc. Natl. Acad. Sci. USA* 85:2444 (1988), by general methods described for search for similarities by Neddleman and Wunsch, *J. Mol. Biol.* 48:443 (1970), including implementation of these algorithms or visual comparison. As used herein, "insulin A-chain" is the chain of insulin that has the highest percentage homology to the A-chain of wild-type human insulin. As used herein, "insulin B-chain" is the chain of insulin that has the highest percentage homology to the B-chain of wild-type human insulin.

In some embodiments, the terms "covalently connected," "covalently conjugated," or "through a covalent conjugation" may be interchangeably used to indicate that two or more atoms, groups, or chemical moieties are bonded or connected via a chemical linkage. In some embodiments, the chemical linkage (which in some embodiments may be referred to as a covalent linkage) may be (e.g., consist of) one or more shared electron pairs (e.g., in a single bond, a double bond, or a triple bond) between two atoms, groups, or chemical moieties." In some embodiments, the chemical (covalent) linkage may further include one or more atoms or functional groups, and may be referred to using the corresponding name of that functional group in the art. For example, a covalent linkage including a —S—S— group may be referred to as a disulfide linkage; a covalent linkage including a —(C=O)— group may be referred to as a carbonyl linkage; a covalent linkage including a —(CF$_2$)— group may be referred to as a difluoromethylene linkage, etc. The type of linkage or functional group within the covalent bond is not limited unless expressly stated, for example when it is described as including or being selected from certain groups. The types or kinds of suitable covalent linkages will be understood from the description and/or context.

In some embodiments, the insulin receptor agonist may be bound or associated with human serum albumin (HSA) before binding to the insulin receptor. For example, insulin receptor agonists that contain any one of DSL-1 to DSL-112 may associate or bind either through hydrogen bonds, ionic associations, or hydrolysable boron ester bonds to HSA. These interactions may occur along the surface of HSA such as salt bridges to lysine residues, cleavable boron ester bonds formed with serine, threonine, and/or tyrosine hydroxyl groups, and/or to specific locations on HSA such as the Site I or Site II small molecule drug binding sites or one or more of the seven fatty acid binding sites (Yamasaki, K. et. al. (2013) Biochimica et Biophysica Acta 12:5435-5443).

In some embodiments, side chains of amino acids may be covalently connected (e.g., linked or cross-linked) through any number of chemical bonds (e.g., bonding moieties) as generally described in Bioconjugate Techniques (Third edition), edited by Greg T. Hermanson, Academic Press, Boston, 2013. For example, the side chains may be covalently connected through an amide, ester, ether, thioether, isourea, imine, triazole, or any suitable covalent conjugation chemistry available in the art for covalently connecting one peptide, protein, or synthetic polymer to a second peptide, protein, or synthetic polymer. The term polymer includes polypeptide. The term "covalent conjugation chemistry" may refer to one or more functional groups included in the bonding moiety, and/or the chemical reactions used to form the bonding moiety.

The term "vicinal diol" refers to a group of molecules in which two hydroxyl groups occupy vicinal positions, that is, they are attached to adjacent atoms. Such molecules may include, but are not limited to, sugars such as hexoses, glucose, mannose and fructose.

In some embodiments, the term "albumin" means human serum albumin or a protein with at least 60% percentage homology to human serum albumin protein. It is to be understood that in some embodiments the albumin may be further chemically modified for the purposes of conjugation. In some embodiments, modifications may include one or more covalently connected linkers. In some embodiments, the term "albumin" means human serum albumin or a protein with at least 80%, 85%, 90%, 95%, 96%, 97%, 98%, 99%, or 100% percentage homology to human serum albumin protein. In some embodiments, the term "albumin" means human serum albumin or a protein with at least 90% percentage homology to human serum albumin protein. In some embodiments, the term "albumin" means human serum albumin or a protein with at least 95% percentage homology to human serum albumin protein. In some embodiments, the term "albumin" means human serum albumin or a protein with at least 99% percentage homology to human serum albumin protein. In some embodiments, albumin is unmodified human serum albumin.

The term "treatment" is meant to include both the prevention and minimization of the referenced disease, disorder, or condition (i.e., "treatment" refers to both prophylactic and therapeutic administration of a compound of the present invention or a composition comprising a compound of the present invention unless otherwise indicated or clearly contradicted by context). The route of administration may be any route which effectively transports a compound of this disclosure to the desired or appropriate place in the body, such as parenterally, for example, subcutaneously, intramuscularly, orally, or intravenously. For parenterally administration, a compound of the disclosure is formulated analogously with the formulation of known insulins. Furthermore, for parenteral administration, a compound of this disclosure is administered analogously with the administration of known insulins and the physicians are familiar with this procedure. The amount of a compound of this disclosure to be administered, the determination of how frequently to administer a compound of this disclosure, and the election of which compound or compounds of this disclosure to administer, optionally together with another antidiabetic compound, is decided in consultation with a practitioner who is familiar with the treatment of the condition (e.g. diabetes) to be treated.

In some embodiments, "therapeutic composition" and "pharmaceutical composition" as used herein means a composition that is intended to have a therapeutic effect such as pharmaceutical compositions, genetic materials, biologics, and other substances. Pharmaceutical compositions may be configured to function in the body with therapeutic qualities; concentration may be altered to reduce the frequency of replenishment, and the like. In some embodiments, "therapeutically effective amount" and "prophylactically effective amount" refer to an amount that provides a therapeutic benefit in the treatment, prevention, or management of a disease or an overt symptom of the disease. The therapeutically effective amount may treat a disease or condition, a symptom of disease, or a predisposition toward a disease, with the purpose to cure, heal, alleviate, relieve, alter, remedy, ameliorate, improve, or affect the disease, the symptoms of disease, or the predisposition toward disease. The set or specific amount that is therapeutically effective can be readily determined by an ordinary medical practitioner, and may vary depending on factors known in the art, such as, e.g. the type of disease, the patient's history and age, the stage of disease, and the administration of other therapeutic agents. In some embodiments, modified insulins described herein are delivered to the body by injection or inhalation, or by other routes, and can reversibly bind to soluble glucose in a non-depot form. In some embodiments, modified insulins described herein are released over an extended period of time from a local depot in the body or from bound forms to proteins in the serum such as albumin. In some embodiments, the release of modified insulin is accelerated at elevated glucose levels, and in some embodiments such release rate may be dependent on blood sugar levels or levels of other small molecules in the blood including diol containing molecules. In some embodiments the release, bioavailability, and/or solubility of modified insulins described herein is controlled as a function of blood or serum glucose concentrations or concentrations of other small molecules in the body.

Additionally, unless otherwise stated, structures described herein are also meant to include compounds that differ only in the presence of one or more isotopically enriched atoms. For example, compounds having the present structures except for the replacement of hydrogen by deuterium (2H) or tritium ($^3$H), or the replacement of a carbon by a $^{13}$C- or $^{14}$C-carbon atom are within the scope of this disclosure. Such compounds may be useful as, for example, analytical tools, probes in biological assays, or therapeutic agents.

In some embodiments, functional groups can be covalently conjugated or linked via any suitable covalent conjugation chemistry (linker) that can be used to covalently conjugate one functional group or amino acid side chain to another functional group, non-limiting examples include an amide, an ester, an ether, a thioether, an isourea, an imine, and a triazole linker. In some embodiments, functional groups are covalently conjugated through click chemistry reactions as defined in the art. These include, for example, cycloaddition reactions including but not limited to 3+2 cycloadditions, strain-promoted alkyne-nitrone cycloaddition, reactions of strained alkenes, alkene and tetrazine inverse-demand Diels-Alder, Copper(I)-Catalyzed Azide-Alkyne Cycloaddition (CuAAC), thiol-maleimide addition, Strain-promoted azide-alkyne cycloaddition, Staudinger ligation, nucleophilic ring-opening reactions, and additions to carbon-carbon multiple bonds. Some of these reactions are described for example by H. C. Kolb, M. G. Finn and K. B. Sharpless (2001); Click Chemistry: Diverse Chemical Function from a Few Good Reactions, *Angewandte Chemie International Edition* 40 (11): 2004-2021; Kolb and Sharpless, *Drug Discovery Today* 8:1128-1137, 2003; Huisgen, R. *Angew. Chem. Int. Ed. Engl.* 1963, 2, 565; Agard, N. J.; Baskin, J. M.; Prescher, J. A.; Lo, A.; Bertozzi, C. R. *ACS Chem. Biol.* 2006, 1, 644. One skilled in the art will be capable of selecting suitable buffers, pH and reaction conditions for such click reactions. In some embodiments, covalent conjugation is the result of a "bioorthogonal reaction" as defined in the art. Such reactions are, for example, described by Sletten, Ellen M.; Bertozzi, Carolyn R. (2009). Bioorthogonal Chemistry: Fishing for Selectivity in a Sea of Functionality, *Angewandte Chemie International Edition* 48 (38): 6974-98.; Prescher, Jennifer A; Bertozzi, Carolyn R (2005). Chemistry in living systems, *Nature Chemical Biology* 1 (1): 13-21.

In some embodiments, functional groups may be linked using native chemical ligation as described for example by Dawson, P. E.; Muir, T. W.; Clark-Lewis, I.; Kent, S. B. (1994) Synthesis of proteins by native chemical ligation, *Science* 266 (5186): 776-778. As used herein, terms such as "linkage," "covalent conjugation," etc. may refer to any of the chemistries described above in some embodiments. The terms "amine," "amino group," and/or "amine group," when used to describe part of a covalent bond or connectivity, may be interchangeably used to indicate an amino group or an amine group to which the described element is covalently linked. In some embodiments, the amino group or amine group may be a primary amine, a secondary amine, or a fragment such as NH---⊕ to which a conjugation is made and described.

In some embodiments, the amino group or amine group may be the $NH_2$ group at the N-terminus of a peptide or peptide chain, or the $NH_2$ group of a lysine side chain, but embodiments of the present disclosure are not limited thereto. In some embodiments, the connectivity of a first group to a second group is described by reference to an amine or amino group, originating from the second group, that is part of a covalent linkage between the first group and the second group.

For example, an amine of a lysine side chain on X1 may be referred to as an amine, and furthermore may be described as being conjugated through an amide bond in order to specify the structure and connectivity of the functional groups that constitute the covalent bond. If a covalent linkage is via an amine bond or amine linkage, then it is referred to as an amine linkage. It is to be understood that a carbonyl connected to an amine (e.g., a (C=O)—NH moiety) constitutes an amide bond, and thus by definition, an amine linkage is not directly connected to a carbonyl group. Stated another way, the terms "amide bond" and/or "amide linkage," when used to describe a covalent bond or connectivity, may be interchangeably used to indicate a carbonyl connected to an amine (e.g., a (C=O)—NH moiety).

In some embodiments, further modifications include attachment of a chemical entity (e.g., moiety or functional group) such as a carbohydrate group, one or more cis-diol containing groups, one or more phosphate groups, one or more catechol groups, a farnesyl group, an isofarnesyl group, a fatty acid group, or a linker for conjugation, functionalization, or other modifications meant to impact the pharmacokinetics, pharmacodynamics, and/or biophysical solution characteristics of insulin.

In some embodiments, a compound includes a human peptide hormone (e.g., as X1). In some embodiments, the peptide hormone is a polypeptide hormone of the human pancreas. In some embodiments, a compound, such as a compound of Formula I, includes a human insulin or a human insulin analogue. In some embodiments, two different amine groups in insulin are covalently conjugated to as described by Formula I.

It will be understood that human peptide hormone, polypeptide hormone of the human pancreas, insulin, human insulin, modified insulin, and human insulin analogue may be used interchangeably in some of the described embodiments; that is, for example, in certain embodiments "human insulin analogue" may instead be used in embodiments described as using human insulin. In some embodiments, a compound, such as a compound of Formula I, includes a human insulin or a human insulin analogue. In some embodiments, a compound of Formula I includes a human insulin or a human insulin analogue as described by Formula I for p'=1 wherein a single amino group in insulin is conjugated to as described by Formula I. In some embodiments, the amino group is the N-terminus of the B-chain of insulin or an amino group of the side chain of a lysine. In some embodiments, two or more different amine groups in insulin are each independently covalently conjugated to as described by Formula I. In some embodiments, at least one amine group is the N-terminus of the B-chain of insulin. In some embodiments, amino groups comprise amino groups of side chains of lysine residues in insulin.

Various suitable modifications of the peptide hormone (e.g., human polypeptide hormone, for example, Insulin), known to those having ordinary skill in the art, are included in the scope of the disclosure. In some embodiments, the polypeptide of Z1a or the optionally extended polypeptide at the N-terminus of B-chain or C-terminus of A-chain of insulin contain sequences with up to 70%, 80%, 85%, 90%, 95%, 96%, 97%, 98%, 99%, or 100% sequence homology to a human polypeptide sequence. In some embodiments, the polypeptide of Z1a or the optionally extended polypeptide at the N-terminus of B-chain or C-terminus of A-chain of insulin contain one or more lysine residues that are optionally next to a proline residue, such that the proline is C-terminal to lysine. In some embodiments, the amino group of lysine residues is each independently conjugated as described by Formula I.

In some embodiments, insulin is further modified through conjugation to a sugar- or diol-containing molecule. In some embodiments, the human polypeptide hormone is a dual or triple hybrid peptide comprising sequences of two or more human peptide hormones and which can act through multiple receptors; for example, a glucose-dependent insulinotropic polypeptide (GIP) and GLP-1 receptor agonist or GLP-1/GIP/glucagon triple agonist. In some embodiments, the human polypeptide hormone is a gut hormone. In some embodiments, the human polypeptide hormone is chosen from c-peptide, adrenocorticotropic hormone (ACTH), amylin, angiotensin, atrial natriuretic peptide (ANP), calcitonin, cholecystokinin (CCK), gastrin, ghrelin, glucagon, growth hormone, follicle-stimulating hormone (FSH), insulin, leptin, melanocyte-stimulating hormone (MSH), oxytocin, parathyroid hormone (PTH), prolactin, renin, somatostatin, thyroid-stimulating hormone (TSH), thyrotropin-releasing hormone (TRH), vasopressin, vasoactive intestinal peptide, a neuropeptide, a peptide hormone that impacts cardiovascular health or appetite, a hybrid of one or more of these peptides, and an analogue of one of these peptides. In some embodiments, compounds comprise a human polypeptide hormone further modified, for example, through the covalent conjugation to polymers, XTEN protein sequences or aliphatic chains. In some embodiments, polymer modified compounds have a longer circulation time in the blood. In some embodiments, polymer modified compounds have a circulation time in the blood such that they are suitable for injection once a day injection, once a week injection, or once a month injection. In some embodiments, a human polypeptide hormone or the analogue thereof includes one or more L- or D-natural or unnatural amino acids that are each independently one of the twenty canonical amino acids or a non-canonical amino acid.

In some embodiments, the insulin receptor agonist is an insulin analogue comprising an A-chain and a B-chain, wherein the A-chain comprises a sequence selected from SEQ ID NOs 1, 25, 24051, and 24052, and the B-chain comprises a sequence selected from SEQ ID NOs 24060, 24061, 24062, 24063, 24064, and 25000-25397. In some embodiments, an insulin analogue comprises an A-chain comprising sequence 24051 and a B-chain comprising a sequence selected from 25000, 25001, 25006-25009, 25076, 25077, 25082-25085, 25228, 25229, 25232, 25234-25237, 25304, 25305, 25308, and 25310-25313. In some embodiments, an insulin analogue comprises an A-chain comprising sequence 24051 and a B-chain comprises a sequence selected from 25011, 25012, 25017-25020, 25087, 25088, 25093-25096, 25229, 25239, 25232, 25240, 25245-25248, 25305, 25308, 25315, 25316, and 25321-25324. In some embodiments, an insulin analogue comprises an A-chain comprising sequence 24051 and a B-chain comprising a sequence selected from 25228, 25229, 25232, 25234-25237, 25304, 25305, 25308, and 25310-25313. In some embodiments, an insulin analogue comprises an A-chain comprising sequence 24051 and a B-chain comprising a sequence selected from 25011, 25012, 25017-25020, 25087, 25088, 25093-25096, 25229, 25232, 25305 and 25308. In some embodiments, an insulin analogue comprises a human insulin with an A-chain and a B-chain wherein up to six residues have been mutated, deleted or additionally inserted into each of the A-chain and/or the B-chain. In some embodiments thereof, the insulin analogue includes insulins containing A- and B-chains with a connecting peptide connecting the C-terminus for the B-chain to the N-terminus for the A-chain, and the connecting peptide includes the natural proinsulin C-peptide as well as shorter version of the C-peptide as is known in the art, wherein shorter versions of the C-peptide allow the single chain insulin to retain biological activity and/or potency.

The words analog and analogue are alternative spellings of the same word, are interchangeably used herein and have the same meaning. In the context of a human hormone, an endocrine hormone, insulin, human insulin, glucagon, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, an analogue means any related sequences resulting from the parent sequence that includes up to 8 mutations, deletions or insertions of amino acids and/or additional chemical modifications. In some embodiments, as is known in the art such analogs may enhance biological activity, pharmacokinetics, pharmacodynamics, potency, stability and or chemical, and physical characteristics.

In some embodiments, a human hormone analog includes one or more residues that are 2-aminoisobutyric acid and/or other artificial (i.e., unnatural) amino acids.

In some embodiments, in an insulin analog the C-terminus of the B-chain of insulin is covalently conjugated to the N-terminus of the A-chain. In some embodiments, the C-terminus of the B-chain of insulin is covalently conjugated to the N-terminus of the A-chain and the connecting peptide is a C-peptide. In some embodiments, the C-terminus of the B-chain of insulin is covalently conjugated to the N-terminus of the A-chain and the connecting peptide is a C-peptide and further includes any intermediate compounds that comprise a conjugate of Formula I.

In some embodiments, the insulin analog includes insulin lispro, or a glargine-type of modification, or any suitable modification to human insulin that impacts the pharmacokinetics or half-life of insulin in the body. In some embodiments, the insulin lispro used to prepare the PEGylated insulin lispro compounds of the present invention may be prepared by any of a variety of recognized peptide synthesis techniques including solution-phase methods, solid-phase methods, semi-synthetic methods, and recombinant DNA methods. For example, U.S. Pat. No. 5,700,662 (Chance, et al.) and European Patent No. 214 826 (Brange, et al.), disclose the preparation of various insulin analogs. The A- and B-chains of insulin lispro may also be prepared via a proinsulin-like precursor molecule using recombinant DNA techniques. In some embodiments, a proinsulin-like precursor is used to make the insulin lispro used to make the PEGylated insulin lispro of the present invention.

In some embodiments, the insulin portion of the present compounds may be prepared via production of a precursor protein molecule using recombinant DNA techniques. The DNA, including cDNA and synthetic DNA, may be double-stranded or single-stranded. The coding sequences that encode the precursor protein molecule described herein may vary as a result of the redundancy or degeneracy of the genetic code. The DNA may be introduced into a host cell in order to produce the precursor protein of the present invention. An appropriate host cell is either transiently or stably transfected or transformed with an expression system for producing the precursor protein. The host cells may be bacterial cells such as K12 or B strains of *Escherichia coli*, fungal cells such as yeast cells, or mammalian cells such as Chinese hamster ovary ("CHO") cells. The expression vectors are typically replicable in the host organisms either as episomes or as an integral part of the host chromosomal DNA. Commonly, expression vectors will contain selection markers, e.g., tetracycline, neomycin, and dihydrofolate reductase, to permit selection of those cells transformed with the desired DNA sequences.

In some embodiments, the polypeptide hormone is glucagon. In some embodiments, glucagon has additional mutations and modifications that are known to impact solubility and solution stability of glucagon. In some embodiments, a compound, such as a compound of Formula I, comprises a conjugation of a Z1a to the N-terminus of the B-chain of insulin through a peptide bond, and at least one additional conjugation described by Formula I to insulin. In some embodiments, the additional conjugation is to a lysine residue in insulin. In some embodiments, at least one such lysine is a residue between position 15 and the C-terminus of the B-chain of insulin. In some embodiments, the lysine residue is optionally next to a proline, glycine, arginine, threonine or serine. In some embodiments, one or more amino acids in Formula I is a D-amino acid. In some embodiments, any secondary or primary amine in a compound, such as a compound represented by Formula I, is each independently optionally acetylated. In some embodiments, a compound of Formula I has a polypeptide hormone X1 further conjugated to a drug molecule, an imaging agent, a chelator, a contrast agent, a radioactive isotope or a molecule that engages immune cells.

In some embodiments, X1 is a polypeptide hormone comprising a peptide ligand that binds to an extracellular protein receptor. In some embodiments, X1 comprises a polypeptide analogue of a human polypeptide hormone that has at least 50% homology to a natural human polypeptide hormone. In some embodiments, X1 comprises a polypeptide analogue of a human polypeptide hormone that has at least 80%, 85%, 90%, 95%, 96%, 97%, 98%, 99%, or 100% homology to a natural human polypeptide hormone. In some embodiments, X1 comprises a polypeptide analogue of a human polypeptide hormone that has at least 90% homology to a natural human polypeptide hormone. In some embodiments, X1 comprises a polypeptide analogue of a human polypeptide hormone that has at least 95% homology to a natural human polypeptide hormone. In some embodiments, X1 comprises a polypeptide analogue of a human polypeptide hormone that has at least 99% homology to a natural human polypeptide hormone. In some embodiments, X1 is an analogue of human insulin with up to 10 additional residues added to the A-chain or the B-chain of insulin.

In some embodiments, the term "glucose responsiveness" refers to the change in activity in the presence and absence of glucose or in a difference of lower levels and higher levels of glucose (e.g, 3 mM glucose vs 20 mM glucose). In some embodiments the activity of a conjugated insulin is assessed by the concentration of insulin (in nanomolar units (nM) of insulin) required to induce the half maximum response (EC50) in a cell-based assay. Lower EC50 concentrations of conjugated insulins have a higher activity than insulins with higher EC50 concentrations (e.g., an insulin with an EC50 of 3 nM is more active than an insulin with an EC50 of 50 nM). A "glucose response" is observed when the insulin changes from a less active EC50 (higher nM) to a more active EC50 (lower nM) in the absence and presence of glucose or in lower and higher levels of glucose, respectively.

In some embodiments, the compound of Formula I comprises one or more L- or D-artificial amino acids which are not one of the twenty naturally occurring amino acids. In some embodiments, the side chains of such artificial amino acids can be covalently conjugated through a number of reactions, including bio-orthogonal reactions such as, for example, described by: Rostovtsev, V. V., Green, L. G., Fokin, V. V. & Sharpless, K. B. A stepwise huisgen cycloaddition process: copper(I)-catalyzed regioselective "ligation" of azides and terminal alkynes. *Angew. Chem. Int. Ed.* 41, 2596-2599 (2002), or by: Liang, Y., Mackey, J. L., Lopez, S. A., Liu, F. & Houk, K. N. Control and design of mutual orthogonality in bioorthogonal cycloadditions. *J. Am. Chem. Soc.* 134, 17904-17907 (2012). In some embodiments, Z1a contains one or more L- or D-artificial amino acids that are not one of the twenty naturally occurring amino acids. In some embodiments, the side chains of two amino acids in Z1a are covalently conjugated together through a triazole bond.

Insulin hormone is an important regulator of blood glucose (sugar) levels. In a normal individual, insulin is present and, when released by the pancreas, it acts to reduce blood sugar levels, for example, by binding to and activating the insulin receptor, triggering glucose absorption by liver, fat, and skeletal muscle cells. Diabetes mellitus (DM), commonly referred to as diabetes, is a group of metabolic diseases characterized by the persistence of high blood sugar levels over a prolonged period.

As used herein, "insulin" encompasses both wild-type and altered forms of insulin capable of binding to and activating the insulin receptor, or capable of causing a measurable reduction in blood glucose when administered in vivo and encompasses both wild-type and altered forms of human insulin capable of binding to and activating the human insulin receptor, or capable of causing a measurable reduction in blood glucose when administered in vivo to a human.

In some embodiments, insulin includes insulin from any species whether in purified, synthetic, or recombinant form and includes human insulin, porcine insulin, bovine insulin, sheep insulin and rabbit insulin. In some embodiments, insulin has two chains: a B- and an A-chain. In some embodiments, the chains are connected together through peptides such as, for example, c-peptide as is known in the art, or a shortened version of the c-peptide, and in other embodiments the insulin may be provided as a proinsulin (insulin precursor) that can be further processed into mature insulin. A variety of altered forms of insulin are known in the art and may be chemically altered such as by addition of a chemical moiety such as a PEG group or a fatty acyl chain. Altered insulins may be mutated including additions, deletions or substitutions of amino acids. In some embodiments the term "desB30" refers to an insulin lacking the B30 amino acid residue.

As used herein, the term "insulin analogue" means a modified human insulin having insulin receptor agonist activity wherein from one to 10 amino acid residues of the insulin have been modified (e.g., substituted, deleted, added (i.e. extended), inserted, and any combination thereof) relative to human insulin. In this context, an insertion or addition of one or more amino acids is considered a single modification. For example, an insulin analogue may have from one to 9 modified amino acid residues. As yet another example, an insulin analogue may have from one to 8 modified amino acid residues. As yet another example, an insulin analogue may have from one to 7 modified amino acid residues. As yet another example, an insulin analogue may have from one to 6 modified amino acid residues. As yet another example, an insulin analogue may have from one to 5 modified amino acid residues. As yet another example, an insulin analogue may have from one to 4 modified amino acid residues. As yet another example, an insulin analogue may have from one to 3 modified amino acid residues. As yet another example, an insulin analogue may have from one to 2 modified amino acid residues. In some embodiments, an insulin analogue may have 2, 3, 4, 5, 6, 7, 8, or 9 modified amino acid residues.

Modifications in the insulin molecule are denoted stating the chain (A or B), the position, and the one or three letter code for the amino acid residue substituting the native amino acid residue. Herein terms like "A1", "A2" and "A3" etc. indicates the amino acid in position 1, 2 and 3 etc., respectively, in the A chain of insulin (counted from the N-terminal end). Similarly, terms like $B_1$, $B_2$ and $B_3$ etc. indicates the amino acid in position 1, 2 and 3 etc., respectively, in the B chain of insulin (counted from the N-terminal end). Using the one letter codes for amino acids, terms like A21A, A21G and A21Q designates that the amino acid in the A21 position is A, G and Q, respectively. Using the three letter codes for amino acids, the corresponding expressions are A21Ala, A21 Gly, and A21 Gln, respectively.

Thus, for example, an insulin analogue having 4 modifications comprises an A-chain and a B-chain, wherein the A-chain comprises sequence GIVEQCCTSICSLYQLE-NYCN (SEQ ID NO: 25737); and wherein the B-chain comprises sequence GKGSHKFVNQHLCGSHLVEALYL-VCGKRGFFYTPR (SEQ ID NO: 25738), where the A chain has the wild-type sequence of chain A of human insulin (e.g. no mutations, deletions, additions) and the B chain has been extended at the N-terminal with GKGSHK (SEQ ID NO: 25726) (i.e. 6 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e, Thr) in the B chain is deleted (as illustrated below (SEQ ID NOS 25737 and 25738, respectively, in order of appearance)).

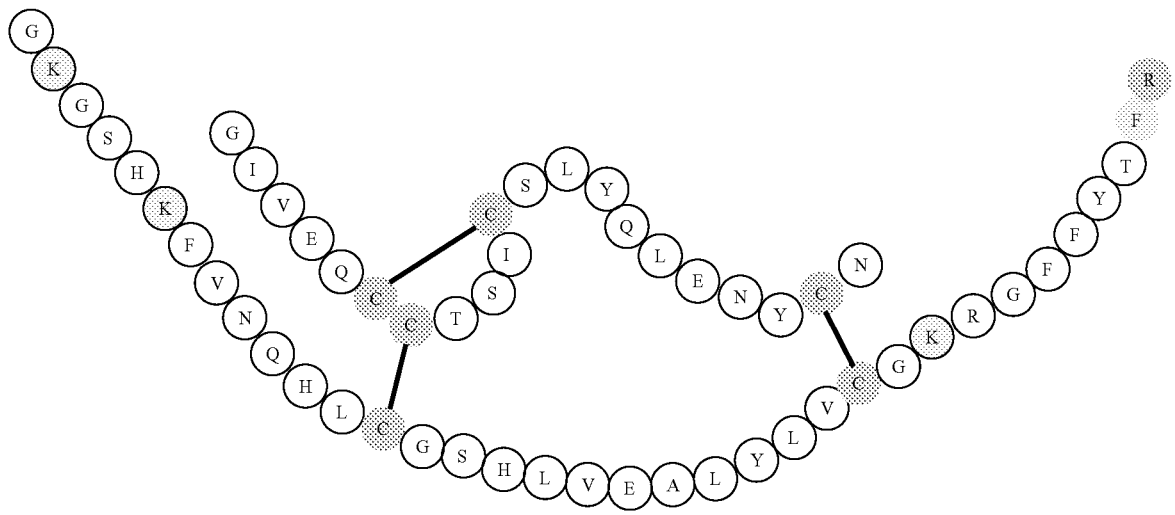

As yet another example, an insulin analogue having 7 modifications comprises an A-chain and a B-chain, wherein the A-chain comprises sequence GIVEQCCTSICSLYQLE-NYCGK (SEQ ID NO: 25739); and wherein the B-chain comprises sequence KGSHKFVDQHLCGSHLVEALYL-VCGKRGFFYTPR (SEQ ID NO: 25740), where in the A chain the amino acid in position 21 (i.e. N) is substituted with G, and the A chain is extended at the C-terminal with K (i.e. 1 amino acid has been added/appended to the C-terminus), and the B chain has been extended at the N-terminal with KGSHK (SEQ ID NO: 25727) (i.e. 5 amino acids have been added/appended to the N-terminus), and where the amino acid in position 3 (i.e. N) in the B chain is substituted with D, and where the amino acid in position 21 (i.e. E) in the B chain is substituted with K, and the amino acid in position 29 (i.e. K) in the B chain is substituted with R, and the amino acid in position 30 (i.e. T) in the B chain is deleted (as illustrated below (SEQ ID NOS 25739 and 25740, respectively, in order of appearance)).

As yet another example, an insulin analogue having 2 modifications comprises an A-chain and a B-chain, wherein the A-chain comprises sequence GIVEQCCTSICSLYQLE-NYCN (SEQ ID NO: 25731); and wherein the B-chain comprises sequence KFVNQHLCGSHLVEALYL-VCGKRGFFYTPKT (SEQ ID NO: 25741), where the A chain has the wild-type sequence of chain A of human insulin (e.g. no mutations, deletions, additions) and the B chain has been extended at the N-terminal with K (i.e. 1 amino acid has been added/appended to the N-terminus), and where the amino acid in position 21 (i.e. E) in the B chain is substituted with K (as illustrated below (SEQ ID NOS 25731 and 25741, respectively, in order of appearance)).

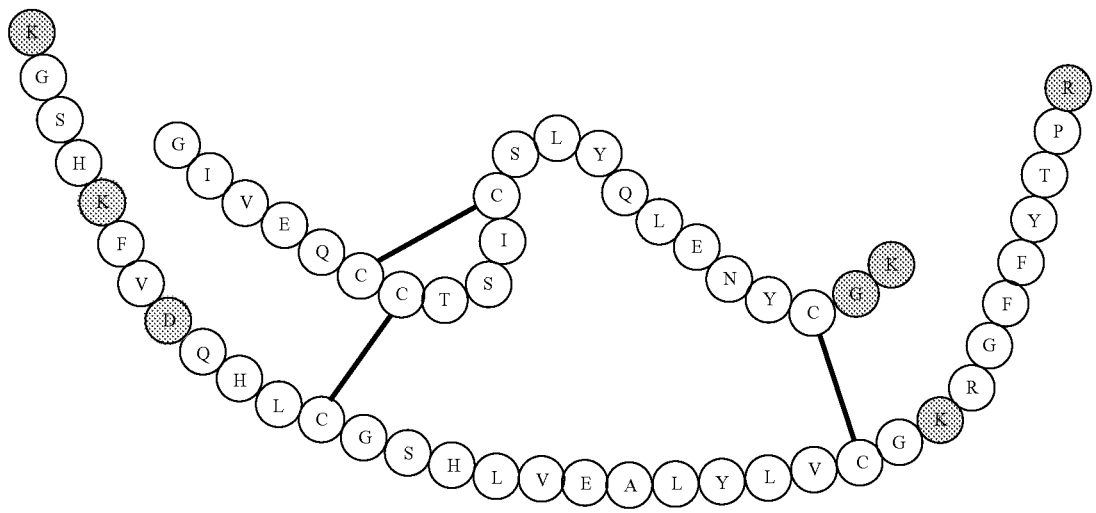

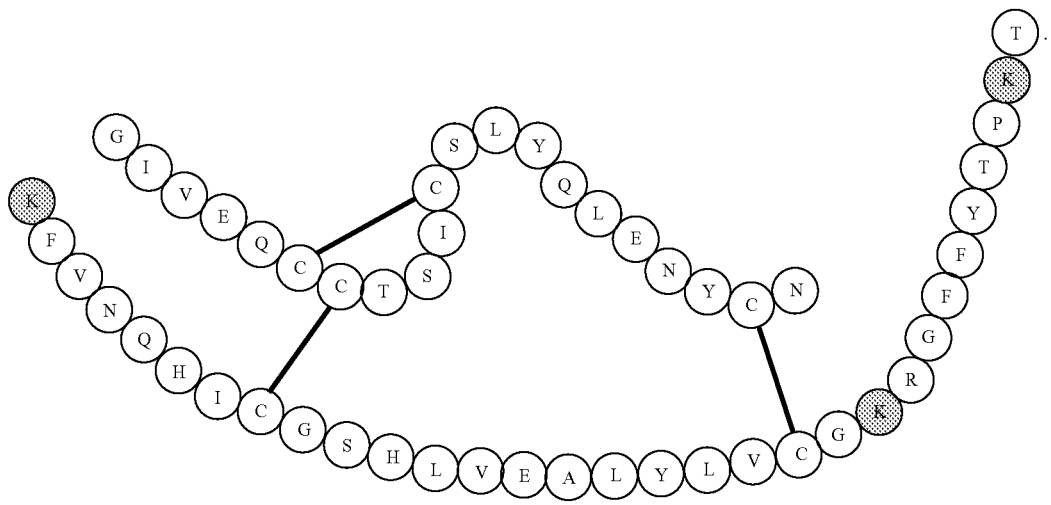

As yet another example, an insulin analogue having 6 modifications comprises an A-chain and a B-chain, wherein the A-chain comprises sequence GIVEQCCTSICSLYQLE-NYCGK (SEQ ID NO: 25732); and wherein the B-chain comprises sequence KGSHKFVNQHLCGSHLVEALYL-VCGKRGFFYTPR (SEQ ID NO: 25742), where in the A chain the amino acid in position 21 (i.e. N) is substituted with G, and the A chain is extended at the C-terminal with K (i.e. 1 amino acid has been added/appended to the C-terminus), and the B chain has been extended at the N-terminal with KGSHK (SEQ ID NO: 25727) (i.e. 5 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e. T) in the B chain is deleted (as illustrated below (SEQ ID NOS 25732 and 25742, respectively, in order of appearance)).

As yet another example, an insulin analogue having 4 modifications comprises an A-chain and a B-chain, wherein the A-chain comprises sequence GIVEQCCTSICSLYQLE-NYCN (SEQ ID NO: 25733); and wherein the B-chain comprises sequence KGSHFVNQHLCGSHLVEALYL-VCGKRGFFYTPR (SEQ ID NO: 25743); where the A chain has the wild-type sequence of chain A of human insulin (e.g. no mutations, deletions, additions) and the B chain has been extended at the N-terminal with KGSH (SEQ ID NO: 25728) (i.e. 4 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e, Thr) in the B chain is deleted (as illustrated below (SEQ ID NOS 25733 and 25743, respectively, in order of appearance)).

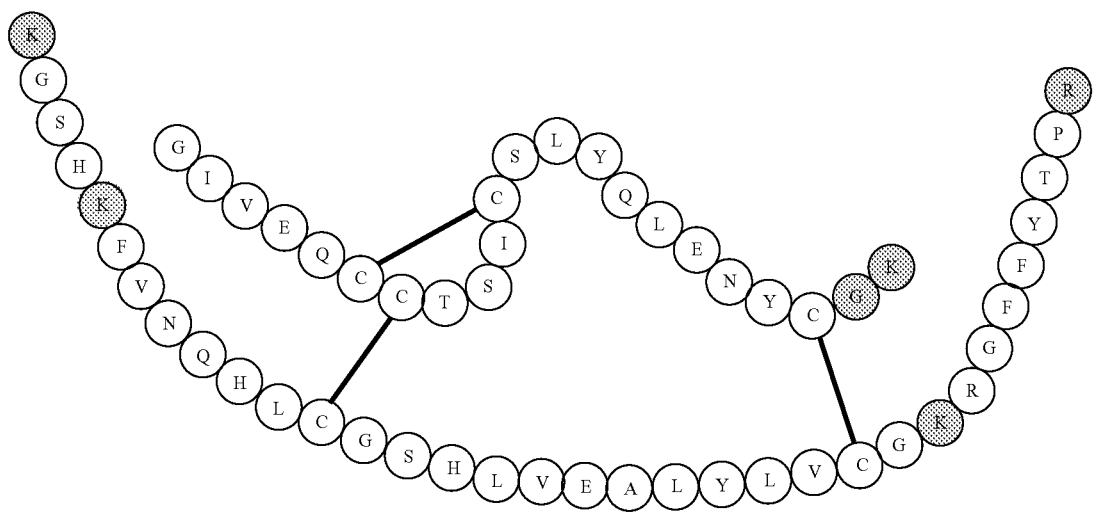

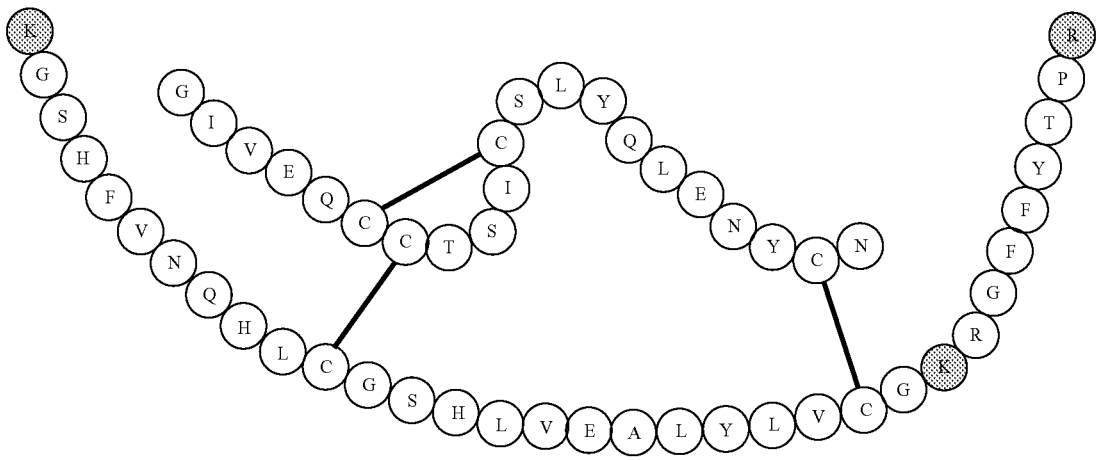

As yet another example, an insulin analogue having 5 modifications comprises an A-chain and a B-chain, wherein the A-chain comprises sequence GIVEQCCTSICSLYQLE-NYCN (SEQ ID NO: 25734); and wherein the B-chain comprises sequence KGSHQHLCGSHLVEALYL-VCGKRGFFYTPR (SEQ ID NO: 25744);

where the A chain has the wild-type sequence of chain A of human insulin (e.g. no mutations, deletions, additions) and the B chain has been extended at the N-terminal with KGSH (SEQ ID NO: 25728) (i.e. 4 amino acids have been added/appended to the N-terminus), and the first 3 residue (FVN) has been deleted, and where the amino acid in position 21 (i.e. E) in the B chain is substituted with K, and the amino acid in position 29 (i.e. K) in the B chain is substituted with R, and the amino acid in position 30 (i.e, Thr) in the B chain is deleted (as illustrated below (SEQ ID NOS 25734 and 25744, respectively, in order of appearance)).

As yet another example, an insulin analogue having 5 modifications comprises an A-chain and a B-chain, wherein the A-chain comprises sequence GIVEQCCTSICSLYQLE-NYCN (SEQ ID NO: 25735); and wherein the B-chain comprises sequence KGSHKQHLCGSHLVEALYL-VCGKRGFFYTPR (SEQ ID NO: 25745);

where the A chain has the wild-type sequence of chain A of human insulin (e.g. no mutations, deletions, additions) and the B chain has been extended at the N-terminal with KGSHK (SEQ ID NO: 25727) (i.e. 5 amino acids have been added/appended to the N-terminus), and the first 3 residue (FVN) has been deleted, and where the amino acid in position 21 (i.e. E) in the B chain is substituted with K, and the amino acid in position 29 (i.e. K) in the B chain is substituted with R, and the amino acid in position 30 (i.e, Thr) in the B chain is deleted (as illustrated below (SEQ ID NOS 25735 and 25745, respectively, in order of appearance)).

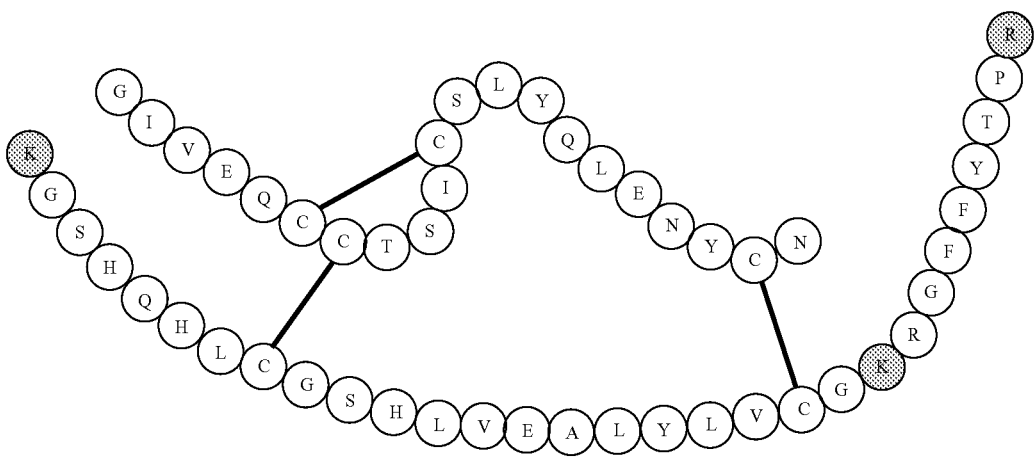

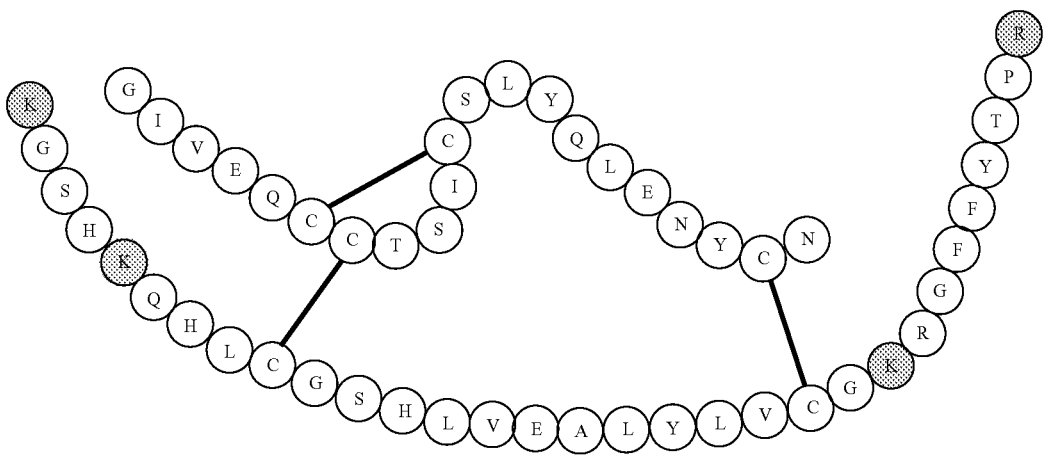

As yet another example, an insulin analogue having 2 modifications comprises an A-chain and a B-chain, wherein the A-chain comprises sequence GIVEQCCTSICSLYQLE-NYCN (SEQ ID NO: 25736); and wherein the B-chain comprises sequence GKGGGGSGGGGSGGGGSFVNQHLCGSHLVEALYL-VCGERGFFYTPK (SEQ ID NO: 25746), where the A chain has the wild-type sequence of chain A of human insulin (e.g. no mutations, deletions, additions) and the B chain has been extended at the N-terminal with GKGGGGSGGGGSGGGGS (SEQ ID NO: 25729) (i.e. 17 amino acids have been added/appended to the N-terminus), and the amino acid in position 30 (i.e, Thr) in the B chain is deleted (as illustrated below (SEQ ID NOS 25736 and 25746, respectively, in order of appearance)).

moiety such as a PEG group or a fatty acyl chain. In some embodiments, altered insulins/insulin analogues/analogs, which are used herein interchangeably, may be mutated including additions, deletions or substitutions of amino acids. Different protomers of insulin may result from these changes and be incorporated into some embodiments. In some embodiments, active forms of insulins have fewer than 11 such modifications (e.g., 1-4, 1-3, 1-9, 1-8, 1-7, 1-6, 2-6, 2-5, 2-4, 1-5, 1-2, 2-9, 2-8, 2-7, 2-3, 3-9, 3-8, 3-7, 3-6, 3-5, 3-4, 4-9, 4-8, 4-7, 4-6, 4-5, 5-9, 5-8, 5-7, 5-6, 6-9, 6-8, 6-7, 7-9, 7-8, 8-9, 9, 8, 7, 6, 5, 4, 3, 2 or 1). As used herein, the wild-type sequence of human insulin (A-chain and B-chain), has an A-chain with the amino acid sequence GIVEQCCTSICSLYQLENYCN (SEQ ID NO: 1), and a B-chain having the amino acid sequence

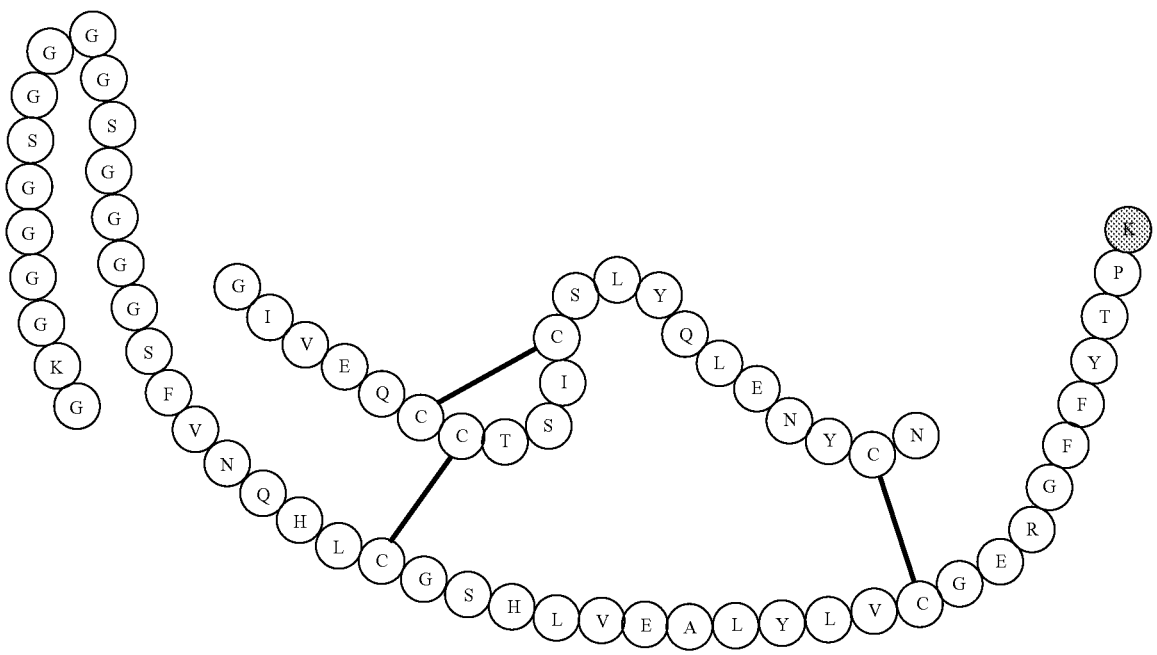

In some embodiments, insulin analogues include insulin that is chemically altered as compared to wild type human insulin, such as, but not limited to, by addition of a chemical FVNQHLCGSHLVEALYLVCGERGFFYTPKT (SEQ ID NO: 2). In some embodiments, an insulin analogue has at least 70% sequence homology to a wild-type human insulin.

In some embodiments, an insulin analogue has at least 80% sequence homology to a wild-type human insulin. In some embodiments, an insulin analogue has at least 90% sequence homology to a wild-type human insulin. In some embodiments, an insulin analogue has at least 95%, 96%, 97%, or 95% sequence homology to a wild-type human insulin. In some embodiments, an insulin analogue has at least 99% sequence homology to a wild-type human insulin.

Human insulin differs from rabbit, porcine, bovine, and sheep insulin in amino acids A8, A9, A10, and B30, which are in order the following: Thr, Ser, Ile, Thr for human; Thr, Ser, Ile, Ser for rabbit; Thr, Ser, Ile, Ala for porcine; Ala, Gly, Val, Ala for sheep; and Ala, Ser, Val, Ala for bovine. In some embodiments, a modified insulin may be mutated at position B1, B2, B28 or B29, or at positions B28 and B29 of the B-chain. In some embodiments, a modified insulin may be mutated at A1, A2, A21 or other positions of the A-chain. For example, insulin lispro is a fast-acting modified insulin in which the lysine and proline residues on the C-terminal end of the B-chain have been reversed. Insulin as part is a fast-acting modified insulin in which proline has been substituted with aspartic acid at position B28. It is contemplated in some embodiments of the present disclosure that insulins mutated at B28 and B29 may further include additional mutations. For example, insulin glulisine is a fast-acting modified insulin in which aspartic acid has been replaced by a lysine residue at position B3, and lysine has been replaced by a glutamic acid residue at position B29. In some embodiments, longer acting and higher stability insulin analogs are covalently modified as described by Formula I, and may contain mutations such as tyrosine at A14 replaced with glutamic acid, the tyrosine at B16 replaced with histidine, and the phenylalanine at B25 replaced with a histidine.

In some embodiments, the isoelectric point of insulins herein may be shifted relative to wild-type human insulin using any suitable method, for example by addition or substitution of suitable amino acids. In some embodiments, the isoelectric point of the modified insulins may be modulated by glucose (e.g., by interaction with glucose). For example, insulin glargine is a basal insulin in which two arginine residues have been added to the C-terminus of the B-peptide, and A21 has been replaced by glycine. In some embodiments, the insulin may not have one or more of the residues B1, B2, B3, B26, B27, B28, B29, and B30 (e.g., the insulin may be a deletion mutant at one or more of the listed residues). In some embodiments, the insulin molecule contains up to five additional amino acid residues on the N- or C-terminus of the A-chain or B-chain. In some embodiments, one or more amino acid residues are located at positions A1, A21, B1, B29, B30 and/or B31 or are missing. In some embodiments, an insulin molecule of the present disclosure is mutated such that one or more amino acids are replaced (substituted) with their acidic forms. In some embodiments, an asparagine is replaced with aspartic acid or glutamic acid. In some embodiments, glutamine is replaced with aspartic acid or glutamic acid. In some embodiments, A21 may be an aspartic acid, B3 may be an aspartic acid, or both positions may contain an aspartic acid. One skilled in the art will recognize that it is possible to make any previously reported, or widely accepted mutations or modifications to insulin that retains biological activity, and that such an insulin analogue can be used in embodiments of the present disclosure. In some embodiments, an insulin may be linked at any position to a fatty acid, or acylated with a fatty acid at any amino group, including those on lysine side chains and the alpha-amino group on the N-terminus of insulin, and the fatty acid may include a C8, C9, C10, C11, C12, C14, C15, C16, C17, or C18 chain. In some embodiments, the fatty acid chain is 8-20 carbons long. In some embodiments, is an insulin detemir, in which a myristic acid is covalently conjugated to lysine at B29, and B30 is deleted or absent. In some embodiments, position B28 of the insulin molecule is lysine and the epsilon(s)-amino group of this lysine is conjugated to a fatty acid.

In some embodiments, the N- or C-terminal end of the A- or B-chain of the modified insulin is ligated using a peptide ligase. In some embodiments, a polypeptide is added to the C-terminus of the insulin A- and/or B-chain or to the N-terminus of insulin A- and/or B-chain using a protein ligase, and in some embodiments thereof the ligase is chosen from sortases, butelases, Trypsiligases, Subtilisins, Peptiligases or enzymes having at least 75% homology to these ligases. In some embodiments, ligation is achieved through expressed protein ligation as described in: Muir T W, Sondhi D, Cole P A. "Expressed protein ligation: a general method for protein engineering." *Proc Nat Acad Sci USA*. 1998; 95(12):6705-6710. In some embodiments, the polypeptide is linked to the modified insulin using Staudinger ligation, utilizing the Staudinger reaction and as described for example in Nilsson, B. L.; Kiessling, L. L.; Raines, R. T. (2000). "Staudinger ligation: A peptide from a thioester and azide". *Org. Lett.* 2 (13): 1939-1941. In some embodiments, a polypeptide is conjugated to the modified insulin using Ser/Thr ligation as, for example, described in: Zhang Y, Xu C, Kam H Y, Lee C L, Li X. 2013, "Protein chemical synthesis by serine/threonine ligation." *Proc. Natl. Acad. Sci. USA*. 17:6657-6662. In some embodiments, the B-chain itself has less than 32 amino acids or 34 amino acids, and in some embodiments the insulin has 4 disulfide bonds instead of 3. There are disulfide bonds present in the A and B chains of insulin. For example, a disulfide bond exists between the cysteine at position 6 of SEQ ID NO:1 and the cysteine at position 11 of SEQ ID NO:1, a disulfide bond exists between the cysteine at position 7 of SEQ ID NO:1 and the cysteine at position 7 of SEQ ID NO:2, and a disulfide bond exists between the cysteine at position 20 of SEQ ID NO:1 and the cysteine at position 19 of SEQ ID NO:2.

In some embodiments, a modified insulin of the present disclosure comprises one or more mutations and/or chemical modifications including, but not limited to one of the following insulin molecules: $N^{\epsilon B29}$-octanoyl-$Arg^{B0}Gy^{A21}Asp^{B3}Arg^{B31}Arg^{B32}$-HI, $N^{\epsilon B29}$-octanoyl-$Arg^{B31}Arg^{B32}$-HI, $N^{\epsilon B29}$-octanoyl-$Arg^{A0}Arg^{B31}Arg^{B32}$-HI, $N^{\epsilon B28}$-myristoyl-$Gly^{A21}Lys^{B28}Pro^{B29}Arg^{B31}Arg^{B32}$-HI, $N^{\epsilon B28}$-myristoyl-$Gly^{A21}Gln^{B3}Lys^{B28}Pro^{B30}Arg^{B31}Arg^{B32}$-HI, $N^{\epsilon B28}$-myristoyl-$Arg^{A0}Gly^{A21}Lys^{B28}Pro^{B29}Arg^{B31}Arg^{B32}$-HI, $N^{\epsilon B28}$-myristoyl-$Arg^{A0}Gly^{A21}Gln^{B3}Lys^{B28}Pro^{B29}Arg^{B31}Arg^{B32}$-HI, $N^{\epsilon B28}$-myristoyl-$Arg^{A0}Gly^{A21}Asp^{B3}Lys^{B28}Pro^{B29}Arg^{B31}Arg^{B32}$-HI, $N^{\epsilon B28}$-myristoyl-$Lys^{B28}Pro^{B29}Arg^{B31}Arg^{B32}$-HI, $N^{\epsilon B28}$-myristoyl-$Arg^{A0}Lys^{B28}Pro^{B29}Arg^{B31}Arg^{B32}$-HI, $N^{\epsilon B28}$-octanoyl-$Gly^{A21}Lys^{B28}Pro^{B29}Arg^{B31}Arg^{B32}$-HI, $N^{\epsilon B28}$-octanoyl-$Gly^{A21}Gln^{B3}Lys^{B28}Pro^{B29}Arg^{B31}Arg^{B32}$-HI, $N^{\epsilon B28}$-octanoyl-$Arg^{A0}Gly^{A21}Lys^{B28}Pro^{B29}Arg^{B31}Arg^{B32}$-HI, $N^{\epsilon B29}$-palmitoyl-HI, $N^{\epsilon B29}$-myrisotyl-HI, $N^{\epsilon B28}$-palmitoyl-$Lys^{B28}Pro^{B29}$-HI, $N^{\epsilon B28}$-myristoyl-$Lys^{B28}Pro^{B29}$-HI, $N^{\epsilon B29}$-palmitoyl-des(B30)-HI, $N^{\epsilon B30}$-myristoyl-$Thr^{B29}Lys^{B30}$-HI, $N^{\epsilon B30}$-palmitoyl-$Thr^{B29}Lys^{B30}$-HI, $N^{\epsilon B29}$-(N-palmitoyl-γ-glutamyl)-des(B30)-HI, $N^{\epsilon B29}$-(N-lithocolyl-γ-glutamyl)-des(B30)-HI, $N^{\epsilon B29}$-(ω-carboxyheptadecanoyl)-des(B30)-HI, $N^{\epsilon B29}$-(ω-carboxyheptadecanoyl)-HI, $N^{\epsilon B29}$-octanoyl-HI, $N^{\epsilon B29}$-myristoyl-$Gly^{A21}Arg^{B31}Arg^{B31}$-HI, $N^{\epsilon B29}$-myristoyl-$Gly^{A21}Gln^{B3} Arg^{B31}Arg^{B32}$-HI, $N^{\epsilon B29}$-myristoyl- Arg$^{A0}$Gly$^{A21}$Arg$^{B31}$Arg$^{B32}$-HI, N$^{\epsilon B29}$-Arg$^{A0}$Gly$^{A21}$Gln$^{B3}$Arg$^{B31}$Arg$^{B32}$-HI, N$^{\epsilon B29}$-myristoyl-Arg$^{A0}$Gly$^{A21}$Asp$^{B3}$Arg$^{B31}$Arg$^{B32}$-HI, N$^{\epsilon B29}$-myristoyl-Arg$^{B31}$Arg$^{B32}$-HI, N$^{\epsilon B29}$-myristoyl-Arg$^{A0}$Arg$^{B31}$Arg$^{B32}$-HI, N$^{\epsilon B29}$-octanoyl-Gly$^{A21}$Arg$^{B31}$Arg$^{B32}$-HI, N$^{\epsilon B29}$-octanoyl-Gly$^{A21}$Gln$^{B3}$Arg$^{B31}$Arg$^{B32}$-HI, N$^{\epsilon B29}$-octanoyl-Arg$^{A0}$Gly$^{A21}$Arg$^{B31}$Arg$^{B32}$-HI, N$^{\epsilon B29}$-octanoyl-Arg$^{A0}$Gly$^{A21}$Gln$^{B3}$Arg$^{B31}$Arg$^{B32}$-HI, N$^{\epsilon B28}$-octanoyl-Arg$^{A0}$Gly$^{A21}$Gln$^{B3}$Lys$^{B28}$Pro$^{B29}$Arg$^{B31}$Arg$^{B32}$-HI, N$^{\epsilon B28}$-octanoyl-Arg$^{A0}$Gly$^{A21}$Asp$^{B3}$Lys$^{B28}$Pro$^{B29}$Arg$^{B31}$Arg$^{B32}$-HI, N$^{\epsilon B28}$-octanoyl-Lys$^{B28}$Pro$^{B29}$Arg$^{B31}$Arg$^{B32}$-HI, N$^{\epsilon B28}$-octanoyl-Arg$^{A0}$Lys$^{B28}$Pro$^{B29}$Arg$^{B31}$ Arg$^{B32}$-HI. N$^{\epsilon B29}$ pentanoyl-Gly$^{A21}$Arg$^{B3}$Arg$^{B32}$-HI, N$^{\alpha B1}$-hexanoyl-Gly$^{A21}$Arg$^{B31}$Arg$^{B32}$-HI, N$^{\alpha A1}$-heptanoyl-Gly$^{A21}$Arg$^{B31}$Arg$^{B32}$-HI, N$^{\epsilon B29}$-octanoyl-N$^{\alpha B1}$-octanoyl-Gly$^{A21}$Arg$^{B31}$Arg$^{B32}$-HI, N$^{\epsilon B29}$-propionyl-N$^{\alpha A1}$-propionyl-Gly$^{A21}$Arg$^{B31}$Arg$^{B32}$-HI, N$^{\alpha A1}$-acetyl-N$^{\alpha B1}$-acetyl-Gly$^{A21}$Arg$^{B31}$Arg$^{B32}$-HI, N$^{\epsilon B29}$-formyl-N$^{\alpha A1}$-formyl-N$^{\alpha B1}$-formyl-Gly$^{A21}$Arg$^{B31}$Arg$^{B32}$-HI, N$^{\epsilon B29}$-formyl-des(B26)-HI, N$^{\alpha B1}$-acetyl-Asp$^{B28}$-HI, N$^{\epsilon B29}$-propionyl-N$^{\alpha A1}$-propionyl-N$^{\alpha B1}$-propionyl-Asp$^{B1}$Asp$^{B3}$Asp$^{B21}$-HI, N$^{\epsilon B29}$-pentanoyl-Gly$^{A21}$-HI, N$^{\alpha B1}$-hexanoyl-Gly$^{A21}$-HI, N$^{\alpha A1}$-heptanoyl-Gly$^{A21}$-HI, N$^{\epsilon B29}$-octanoyl-N$^{\alpha B1}$-octanoyl-Gly$^{A21}$-HI, N$^{\epsilon B29}$-propionyl-N$^{\alpha A1}$-propionyl-Gly$^{A21}$-HI, N$^{\alpha A1}$-acetyl-N$^{\alpha B1}$-acetyl-Gly$^{A21}$-HI, N$^{\epsilon B29}$-formyl-N$^{\alpha A1}$-formyl-N$^{\alpha B2}$-formyl-Gly$^{A21}$-HI, N$^{\epsilon B29}$-butyryl-des(B30)-HI, N$^{\alpha B31}$-butyryl-des(B30)-HI, N$^{\alpha A1}$-butyryl-des(B30)-HI, N$^{\epsilon B29}$-butyryl-N$^{\alpha B31}$-butyryl-des(B30)-HI, N$^{\epsilon B29}$-butyryl-N$^{\alpha A1}$-butyryl-des(B30)-HI, N$^{\alpha A1}$-butyryl-N$^{\alpha B31}$-butyryl-des(B30)-HI, N$^{\epsilon B29}$-butyryl-N$^{\alpha A1}$-butyryl-N$^{\alpha B31}$-butyryl-des(B30)-HI, Lys$^{B28}$Pro$^{B29}$-HI (insulin lispro), Asp$^{B28}$-HI (insulin aspart), Lys$^{B3}$Glu$^{B29}$-HI (insulin glulisine), Arg$^{B31}$Arg$^{B32}$-HI (insulin glargine), N$^{\epsilon B29}$-myristoyl-des(B30)-HI (insulin detemir), Ala$^{B26}$-HI, Asp$^{B1}$-HI, Arg$^{A0}$-HI, Asp$^{B1}$Glu$^{B13}$-HI, Gly$^{A21}$-HI, Gly$^{A21}$Arg$^{B31}$Arg$^{B32}$-HI, Arg$^{A0}$Arg$^{B31}$Arg$^{B32}$-HI, Arg$^{A0}$Gly$^{A21}$Arg$^{B31}$Arg$^{B32}$-HI, des(B30)-HI, des(B27)-HI, des(B28-B30)-HI, des(B1)-HI, des(B1-B3)-HI, N$^{\epsilon B29}$-tridecanoyl-des(B30)-HI, N$^{\epsilon B29}$-tetradecanoyl-des(B30)-HI, N$^{\epsilon B29}$-decanoyl-des(B30)-HI, N$^{\epsilon B29}$-dodecanoyl-des(B30)-HI, N$^{\epsilon B29}$-tridecanoyl-Gly$^{A21}$-des(B30)-HI, N$^{\epsilon B29}$-tetradecanoyl-Gly$^{A21}$-des(B30)-HI, N$^{\epsilon B29}$-decanoyl-Gly$^{A21}$-des(B30)-HI, N$^{\epsilon B29}$-dodecanoyl-Gly$^{A21}$-des(B30)-HI, N$^{\epsilon B29}$-tridecanoyl-Gly$^{A21}$Gln$^{B3}$-des(B30)-HI, N$^{\epsilon B29}$-tetradecanoyl-Gly$^{A21}$Gln$^{B3}$-des(B30)-HI, N$^{\epsilon B29}$-decanoyl-Gly$^{A21}$-Gln$^{B3}$-des(B30)-HI, N$^{\epsilon B29}$-dodecanoyl-Gly$^{A21}$-Gln$^{B3}$-des(B30)-HI, N$^{\epsilon B29}$-tridecanoyl-Ala$^{A21}$-des(B30)-HI, N$^{\epsilon B29}$-tetradecanoyl-Ala$^{A21}$-des(B30)-HI, N$^{\epsilon B29}$-decanoyl-Ala$^{A21}$-des(B30)-HI, N$^{\epsilon B29}$-dodecanoyl-Ala$^{A21}$-des(B30)-HI, N$^{\epsilon B29}$-tridecanoyl-Ala$^{A21}$-Gln$^{B3}$-des(B30)-HI, N$^{\epsilon B29}$-tetradecanoyl-Ala$^{A21}$Gln$^{B3}$-des(B30)-HI, N$^{\epsilon B29}$-decanoyl-Ala$^{A21}$Gln$^{B3}$-des(B30)-HI, N$^{\epsilon B29}$-dodecanoyl-Ala$^{A21}$Gln$^{B3}$-des(B30)-HI, N$^{\epsilon B29}$-tridecanoyl-Gln$^{B3}$-des(B30)-HI, N$^{\epsilon B29}$-tetradecanoyl-Gln$^{B3}$-des(B30)-HI, N$^{\epsilon B29}$-decanoyl-Gln$^{B3}$-des(B30)-HI, N$^{\epsilon B29}$-dodecanoyl-Gln$^{B3}$-des(B30)-HI, N$^{\epsilon B29}$-Z1-Gly$^{A21}$-HI, N$^{\epsilon B29}$-Z2-Gly$^{A21}$-HI, N$^{\epsilon B29}$-Z4-Gly$^{A21}$-HI, N$^{\epsilon B29}$-Z3-Gly$^{A21}$-HI, N$^{\epsilon B29}$-Z1-Ala$^{A21}$-HI, N$^{\epsilon B29}$-Z2-Ala$^{A21}$-HI, N$^{\epsilon B29}$-Z4-Ala$^{A21}$-HI, N$^{\epsilon B29}$-Z3-Ala$^{A21}$-HI, N$^{\epsilon B29}$-Z1-Gly$^{A21}$Gln$^{B3}$-HI, N$^{\epsilon B29}$-Z2-Gly$^{A21}$Gln$^{B3}$-HI, N$^{\epsilon B29}$-Z4-Gly$^{A21}$Gln$^{B3}$-HI, N$^{\epsilon B29}$-Z3-Gly$^{A21}$Gln$^{B3}$-HI, N$^{\epsilon B29}$-Z1-Ala$^{A21}$Gln$^{B3}$-HI, N$^{\epsilon B29}$-Z2-Ala$^{A21}$Gln$^{B3}$-HI, N$^{\epsilon B29}$-Z3-Ala$^{A21}$Gln$^{B3}$-HI, N$^{\epsilon B29}$-Z2-Gln$^{B3}$-HI, N$^{\epsilon B29}$-Z4-Gln$^{B3}$-HI, N$^{\epsilon B29}$-Z3-Gln$^{B3}$-HI, N$^{\epsilon B29}$-Z1-Glu$^{B30}$-HI, N$^{\epsilon B29}$-Z2-Glu$^{B30}$-HI, N$^{\epsilon B29}$-Z4-Glu$^{B30}$-HI, N$^{\epsilon B29}$-Z3-Glu$^{B30}$-HI, N$^{\epsilon B29}$-Z1-Gly$^{A21}$Glu$^{B30}$-HI, N$^{\epsilon B29}$-Z2-Gly$^{A21}$Glu$^{B30}$-HI, N$^{\epsilon B29}$-Z4-Gly$^{A21}$Glu$^{B30}$-HI, N$^{\epsilon B29}$-Z3-Gly$^{A21}$Glu$^{B30}$-HI, N$^{\epsilon B29}$-Z1-Gly$^{A21}$Gln$^{B3}$Glu$^{B30}$-HI, N$^{\epsilon B29}$-Z2-Gly$^{A21}$Gln$^{B3}$Glu$^{B30}$-HI, N$^{\epsilon B29}$-Z4-Gly$^{A21}$Gln$^{B3}$Glu$^{B30}$-HI, N$^{\epsilon B29}$-Z3-Gly$^{A21}$Gln$^{B3}$Glu$^{B30}$-HI, N$^{\epsilon B29}$-Z1-Ala$^{A21}$Glu$^{B30}$-HI, N$^{\epsilon B29}$-Z2-Ala$^{A21}$Glu$^{B30}$-HI, N$^{\epsilon B29}$-Z4-Ala$^{A21}$Gln$^{B30}$-HI, N$^{\epsilon B29}$-Z3-Ala$^{A21}$Glu$^{B30}$-HI, N$^{\epsilon B29}$-Z1-Ala$^{A21}$Gln$^{B3}$Glu$^{B30}$-HI, N$^{\epsilon B29}$-Z2-Ala$^{A21}$Gln$^{B3}$Glu$^{B30}$-HI, N$^{\epsilon B29}$-Z4-Ala$^{A21}$Gln$^{B3}$Glu$^{B30}$-HI, N$^{\epsilon B29}$-Z3-Ala$^{A21}$Gln$^{B3}$Glu$^{B30}$-HI, N$^{\epsilon B29}$-Z1-Gln$^{B3}$Glu$^{B30}$-HI, N$^{\epsilon B29}$-Z2-Gln$^{B3}$Glu$^{B30}$-HI, N$^{\epsilon B29}$-Z4-Gln$^{B3}$Glu$^{B30}$-HI, N$^{\epsilon B29}$-Z3-Gln$^{B3}$Glu$^{B30}$-HI and where Z1 is tridecanoyl, Z2 is tetradecanoyl, Z3 is dodecanoyl, Z4 is decanoyl, and HI is human insulin.

In some embodiments, insulin includes one or more of the following mutations and/or chemical modifications: N$^{\epsilon B28}$-XXXXX-Lys$^{B28}$Pro$^{B29}$-HI, N$^{\alpha B1}$-XXXXX-Lys$^{B28}$Pro$^{B29}$-HI, N$^{\alpha A1}$-XXXXX-Lys$^{B28}$Pro$^{B29}$-HI, N$^{\epsilon B28}$-XXXXX-N$^{\alpha A1}$-XXXXX-Lys$^{B28}$Pro$^{B29}$-HI, N$^{\epsilon B28}$-XXXXX-N$^{\alpha A1}$-XXXXX-Lys$^{B28}$Pro$^{B29}$-HI, N$^{\alpha A1}$-XXXXX-N$^{\alpha B1}$-XXXXX-Lys$^{B28}$Pro$^{B29}$-HI, N$^{\epsilon B28}$-XXXXX-N$^{\alpha A1}$-XXXXX-N$^{\alpha 1}$-XXXXX-Lys$^{B28}$Pro$^{B29}$-HI, N$^{\epsilon B29}$-XXXXX-HI, N$^{\alpha A1}$-XXXXX-HI, N$^{\alpha A1}$-XXXXX-HI, N$^{\epsilon B29}$-XXXXX-N$^{\alpha B1}$-XXXXX-HI, N$^{\epsilon B29}$-XXXXX-N$^{\alpha A1}$-XXXXX-HI, N$^{\alpha A1}$-XXXXX-N$^{\alpha B1}$-XXXXX-HI, N$^{\epsilon B29}$-XXXXX-N$^{\alpha A1}$-XXXXX-N$^{\alpha B1}$-XXXXX-HI, N$^{\epsilon B29}$-YYYYY-HI, N$^{\alpha B1}$-YYYYY-HI, N$^{\alpha A1}$-YYYYY-HI, N$^{\epsilon B29}$-YYYYY-N$^{\alpha B1}$-YYYYY-HI, N$^{\epsilon B29}$-YYYYY-N$^{\alpha A1}$-YYYYY-HI, N$^{\alpha A1}$-YYYYY-N$^{\alpha B1}$-YYYYY-HI, N$^{\epsilon B29}$-YYYYY-N$^{\alpha A1}$-YYYYY-N$^{\alpha B1}$-YYYYY-HI, N$^{\epsilon B28}$-YYYYY-Lys$^{B28}$Pro$^{B29}$-HI, N$^{\epsilon B21}$-YYYYY-Lys$^{B28}$Pro$^{B29}$-HI, N$^{\alpha A1}$-YYYYY-Lys$^{B28}$Pro$^{B29}$-HI, N$^{\epsilon B28}$-YYYYY-N$^{\alpha B1}$-YYYYY-Lys$^{B28}$Pro$^{B29}$-HI, N$^{\epsilon B28}$-YYYYY-N$^{\alpha A1}$-YYYYY-Lys$^{B28}$Pro$^{B29}$-HI, N$^{\alpha A1}$-YYYYY-N$^{\alpha A1}$-YYYYY-Lys$^{B28}$Pro$^{B29}$-HI, N$^{\epsilon B28}$-YYYYY-N$^{\alpha A1}$-YYYYY-N$^{\alpha B1}$-YYYYY-Lys$^{B28}$Pro$^{B29}$-HI, and where YYYYY is one of acetyl or formyl and where XXXXX is one of: propionyl, butyryl, pentanoyl, hexanoyl, heptanoyl, octanoyl, nonanoyl or decanoyl and HI is human insulin.

In some embodiments, insulin may be conjugated through a reactive moiety that is naturally present within the insulin structure or is added prior to conjugation, including, for example, carboxyl or reactive ester, amine, hydroxyl, aldehyde, sulfhydryl, maleimidyl, alkynyl, azido, etc. moieties. Insulin naturally includes reactive alpha-terminal amine and epsilon-amine lysine groups to which NHS-ester, isocyanates or isothiocyanates can be covalently conjugated. In some embodiments, a modified insulin may be employed in which a suitable amino acid (e.g., a lysine or a non-natural amino acid) has been added or substituted into the amino acid sequence in order to provide an alternative point of conjugation in addition to the modified amino acids of the embodiments described herein. In some embodiments, the conjugation process may be controlled by selectively blocking certain reactive moieties prior to conjugation. In some embodiments, insulin may include any combination of modifications and the present disclosure also encompasses modified forms of non-human insulins (e.g., porcine insulin, bovine insulin, rabbit insulin, sheep insulin, etc.) that comprise any one of the aforementioned modifications. It is understood that some embodiments include these and other previously described modified insulins such as those described in U.S. Pat. Nos. 5,474,978; 5,461,031; 4,421,685; 7,387,996; 6,869,930; 6,174,856; 6,011,007; 5,866,538; 5,750,4976; 906,028; 6,551,992; 6,465,426; 6,444,641; 6,335,316; 6,268,335; 6,051,551; 6,034,054; 5,952,297; 5,922,675; 5,747,642; 5,693,609; 5,650,486; 5,547,929; 5,504,188; US 2015/0353619, including non-natural amino acids described or referenced herein and including such modifications to the non-human insulins described herein. It is also to be understood that in some embodiments the insulin may be covalently conjugated to polyethylene glycol polymers, such as polyethylene glycol polymers of no more than Mn 60,000, or covalently conjugated either through permanent or reversible bonds to albumin.

In some embodiments, a compound of the present disclosure (e.g., Formula I) is conjugated to a chelator, and in some embodiments the chelator can be used to capture a radioactive payload, such as gallium 68, copper 64, lutetium 177, or actinium 225. In some embodiments, the chelator is based on DOTA, NOTA, TETA, or 4-arm DOTA, and in some embodiments, the chelator can be linked to the peptide using a PEG linker through amide bonds to the chelator and to the peptide.

In some embodiments, the activity, bioavailability, solubility, isoelectric point, charge and/or hydrophobicity of the modified insulins can be controlled through chemical modifications and/or as result of interaction of a small molecule such as a sugar with the compounds, such as the compounds described herein which are either covalently linked or mixed with insulin.

In some embodiments one or more elements, functional groups, or atoms may be specifically omitted or excluded from a depicted structure (e.g., a terminal functional group may be replaced by a hydrogen atom, or a linking group may be replaced by a bond), for example in Formulae FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226, and it will be understood that such omitted or excluded elements make these groups (structures) distinct and non-equivalent. For example, if an alternative version (variation) of a formula structure does not have a nitro group in R1 for B1 or B2, that variation is not equivalent (e.g., is structurally and chemically inequivalent) to a structure that includes the nitro group, at least because the nitro group changes the pKa of B1 and B2 in physiological conditions and hence the overall affinity of Z1c for glucose.

Rotationally Constrained Tethered Boron Conjugates.

In some embodiments, aromatic boron-containing compounds and/or aromatic boron-containing groups are rotationally constrained tether boron conjugates. In some embodiments, rotationally constrained tether boron conjugates presented in this disclosure contain scaffolds that are rotationally hindered by disfavored steric interactions (e.g. gauche vs anti interactions of substituents), hindered rotation due to bond hybridization (e.g., cis- vs trans-amide rotations), or through rigid covalent bonds (e.g., (E) vs (Z) configurations for alkene moieties). For example, formula FF116 contains alkyl functionalities geminal (e.g., attached to the same atom) to the amine groups that are covalently conjugated to the boronic acid functionalized moieties. Alkyl functionalities may limit the accessible dihedral angles and the rotation freedom around the C—C or C—X bond (commonly referred to as χ (chi) dihedral angles in amino acids). For example, the hydroxyl sidechain on a serine residue can access dihedral angles of 60°, 180°, or 2400 (−60°) with near equal distribution while the hydroxyl sidechain of threonine may only adopt dihedral angles of 1800 or 2400 (−60°). The presence of a methyl group geminal to the hydroxy on threonine may provide steric bulk, creating unfavorable interactions when other bulky substituents are in a gauche conformation relative to the methyl. Formula FF116 contains geminal alkyl substituents which may limit the accessible dihedral angles that the boron conjugated amines adopt, influencing adopted dihedral angles and placing the boronic functionalized groups closer together and allowing for increased binding of the conjugates to target molecules such as proteins or sugars.

In some embodiments, the activity (glucose responsiveness) of the insulin agonist is controlled by the three-dimensional structure of the sensor. For example, FF116A, FF115A, FF225A are constitutional isomers (contain the same molecular formula but different linkages between atoms). In some embodiments, when used with the same linker (FL3) and same insulin backbone (i.e., same A chain (i.e., seq: 1) and same B chain (i.e., seq: 24060)) in Example 23, Example 82, and Example 27, these compounds exhibit different responsiveness to differences in glucose, with Example 23 showing the largest fold change (responsiveness) to glucose over Example 82 and Example 27. In some embodiments, the presence of a methyl group on the FF scaffold (e.g., FF116A, FF225A) has greater potency (e.g., lower $EC_{50}$) than the non-methyl FF scaffold (e.g., FF115A). Example 23 has a fold change of about 7 to 8-fold in response to glucose change of 3 mM to 20 mM glucose, whereas example 27 has a fold change of about 6 and example 82 has a fold change of about 4 in the same range of glucose change. Therefore, the presence of the methyl group in the scaffolds FF116A (having a beta methyl) and FF225A (having an alpha methyl) provide improvement in glucose responsiveness over FF115A (no methyl on the FF scaffold), and moreover glucose responsiveness provided by scaffold FF116A is better than FF225A. As another comparison, a compound having an insulin backbone (i.e., A chain seq: 24051 and B chain seq: 24061) with scaffold FF116A and linker FL3, as shown in example 156, has a diboronate scaffold 3-((2S,3S)-2,3-bis(1-hydroxy-1,3-dihydrobenzo[c][1,2]oxaborole-6-carboxamido)butanamido) propanoic acid which provides a fold change of 4.0 in response to glucose changes of 3 mM to 20 mM. Whereas if in the same example 156 the diboronate sensor is changed to (S)-3-(2,3-bis(1-hydroxy-1,3-dihydrobenzo[c][1,2]oxaborole-6-carboxamido)propanamido)propanoic acid, the fold change observed is 3.6 in response to glucose changes of 3 mM to 20 mM. This shows that the diboronate sensor 3-((2S,3S)-2,3-bis(1-hydroxy-1,3-dihydrobenzo[c][1,2]oxaborole-6-carboxamido)butanamido)propanoic acid (having a methyl on the FF scaffold) provides superior glucose responsiveness on insulin to an insulin containing the sensor (S)-3-(2,3-bis(1-hydroxy-1,3-dihydrobenzo[c][1,2]oxaborole-6-carboxamido)propanamido)propanoic acid (no methyl on the FF scaffold).

In some embodiments, the stereochemistry of isomeric structures (e.g., the stereochemistry of a compound (for example within the Z1c moiety)) may selectively increase the affinity of the conjugate (e.g., the Z1c moiety) for a specific target diol, such as glucose. For example, in some embodiments one or more stereoisomers (e.g., cis- or trans-, (R) or (S), and (E) or (Z)) of Z1c may be selected to increase or decreases the affinity of Z1c (and the molecular architecture or conjugate as a whole) for glucose. In some embodiments, the cis form of Formulae FF12, FF114, FF114A, FF114B, FF115, FF115A, FF115B, FF116, FF117, FF193A, FF203, FF225, and FF226 is used when applicable (e.g., Z1c includes a structure having cis stereochemistry). In some embodiments, the trans form of Formulae FF12, FF115, FF116, FF117, FF193A, FF203, FF225, and FF226 is used when applicable, e.g., when these Formulae include two stereocenters linked by a bond, (e.g., Z1c includes a structure having trans stereochemistry). In some embodiments, the R form of Formulae FF12, FF114, FF114A, FF115, FF115A, FF116, FF117, FF193A, FF203, FF225, and FF226 is used when applicable, e.g., when Formulae FF12, FF114, FF115, FF116, FF117, FF193A, FF203, FF225, and FF226 include at least one stereocenter, (e.g., Z1c includes a structure having R stereochemistry). In some embodiments, the S form of Formulae FF12, FF114, FF115, FF116, FF117, FF193A, FF203, FF225, and FF226 is used when applicable, e.g., when Formulae FF12, FF114, FF115, FF116, FF117, FF193A, FF203, FF225, and FF226 include at least one stereocenter, (e.g., Z1c includes a structure having S stereochemistry). In some embodiments, the S, S form of Formulae FF12, FF114, FF115, FF116, FF117, FF193A, FF203, FF225, FF225A, FF225B, and FF226 is used when applicable, e.g., when Formulae FF12, FF114, FF115, FF116, FF117, FF193A, FF203, FF225, and FF226 include two stereocenters linked by a bond, (e.g., Z1c includes a structure having S,S stereochemistry). In some embodiments, the S,R form of Formulae FF12, FF114, FF115, FF116, FF117, FF193A, FF203, FF225, and FF226 is used when applicable, e.g., when Formulae FF12, FF114, FF115, FF116, FF117, FF193A, FF203, FF225, and FF226 include two stereocenters linked by a bond, (e.g., Z1c includes a structure having S,R stereochemistry). In some embodiments, the R,R form of Formulae FF12 FF114, FF115, FF116, FF117, FF193A, FF203, FF225, and FF226 is used when applicable, e.g., when Formulae FF12, FF114, FF115, FF116, FF117, FF193A, FF203, FF225, and FF226 include two stereocenters linked by a bond, (e.g., Z1c includes a structure having R,R stereochemistry). In some embodiments, the R,S form of Formulae FF12, FF114, FF115, FF116, FF117, FF193A, FF203, FF225, and FF226 is used when applicable, e.g., when Formulae FF12, FF114, FF115, FF116, FF117, FF193A, FF203, FF225, and FF226 include two stereocenters linked by a bond, (e.g., Z1c includes a structure having R,S stereochemistry). In some embodiments, a compound includes one or more tautomers of a compound disclosed herein. In some embodiments, a compound includes one or more stereoisomers or a mixture of stereoisomers of a compound disclosed herein.

In some embodiments, a compound is covalently conjugated to glucagon, GLP-1, GLP-2 or a variation of any of these (e.g., any variation with deletions, insertions and/or replacements of one or more amino acids). In some embodiments any suitable chemical modifications made to insulin discussed herein can be made to glucagon. In some embodiments the conjugate is mixed with a second or drug substance or one or more compounds chosen from: aminoethylglucose, aminoethylbimannose, aminoethyltrimannose, D-glucose, D-galactose, D-Allose, D-Mannose, D-Gulose, D-Idose, D-Talose, N-Azidomannosamine (ManNAz) or N-Azidogalactoseamine (GalNAz) or N-azidoglucoseamine (GlcNAz), 2'-fluororibose, 2'-deoxyribose, glucose, sucrose, maltose, mannose, derivatives of these (e.g., glucosamine, mannosamine, methylglucose, methylmannose, ethylglucose, ethylmannose, etc.), sorbitol, inositol, galactitol, dulcitol, xylitol, arabitol and/or higher order combinations of these (such as linear and/or branched bimannose, linear and/or branched trimannose), molecules containing cis-diols, catechols, tris, and DOPA molecules such as L-DOPA or L-3,4-dihydroxyphenylalanine.

Moreover, one skilled in the art will recognize that in some embodiments, one or more of suitable proteinogenic artificial amino acids can be used (included) in Z1a. For example, in some embodiments one or more of the following artificial amino acids can be used based on the methods described in and referenced through, and the list of amino acids provided in: Liu, C. C.; Schultz, P. G. (2010). "Adding new chemistries to the genetic code." *Annual Review of Biochemistry* 79: 413-44. One skilled in the art will recognize that, in some embodiments, artificial amino acids can be incorporated by peptide synthesis in Z1a which is then covalently conjugated to the drug or insulin, and these include the amino acids referenced herein as well as previously reported non-proteinogenic amino acids. In some embodiments, artificial amino acids exist (e.g., may be included) in the insulin, and in some embodiments thereof, proteinogenic artificial amino acids can be incorporated through recombinant protein expression using suitable methods and approaches, including those described in United States patent and patent applications including: US 2008/0044854, U.S. Pat. Nos. 8,518,666, 8,980,581, US 2008/0044854, US 20140045261, US 2004/0053390, U.S. Pat. Nos. 7,229,634, 8,236,344, US 2005/0196427, US 2010/0247433, U.S. Pat. Nos. 7,198,915, 7,723,070, US 2002/0042097, US 2004/0058415, US 2008/0026422, US 2008/0160609, US 2010/0184193, US 2012/0077228, US 2014/025599, U.S. Pat. Nos. 7,198,915, 7,632,492, 7,723,070, and other proteinogenic artificial amino acids may be introduced recombinantly using methods and approaches described in: U.S. Pat. Nos. 7,736,872, 7,816,320, 7,829,310, 7,829,659, 7,883,866, 8,097,702, 8,946,148.

In some embodiments, cyclic amino acids such as 3-hydroxyproline, 4-hydroxyproline, aziridine-2-earboxylic acid, azetidine-2-carboxylic acid, piperidine-2-carboxylic acid, 3-carboxy-morpholine, 3-carboxy-thiamorpholine, 4-oxaproline, pyroglutamic acid, 1,3-oxazolidine-4-carboxylic acid, 1,3-thiazolidine-4-carboxylic acid, 3-thiaproline, 4-thiaproline, 3-selenoproline, 4-selenoproline, 4-ketoproline, 3,4-dehydroproline, 4-aminoproline, 4-fluoroproline, 4,4-difluoroproline, 4-chloroproline, 4,4-dichloroproline, 4-bromoproline, 4,4-dibromoproline, 4-methylproline, 4-ethylproline, 4-cyclohexyl-proline, 3-phenylproline, 4-phenylproline, 3,4-phenylproline, 4-azidoproline, 4-carboxyproline, a-methylproline, a-ethylproline, a-propylproline, a-allylproline, a-benzylproline, a-(4-fluorobenzyl)-proline, a-(2-chlorobenzyl)-proline, a-(3-chlorobenzyl)-proline, a-(2-bromobenzyl)-proline, a-(4-bromobenzyl)-proline, a-(4-methylbenzyl)-proline, a-(diphenylmethyl)-proline, a-(naphthylmethyl)-proline, D-proline, or S— homoproline, (2S, 4S)-4-fluoro-L-proline, (2S, 4R)-4-fluoro-L-proline, (2S)-3,4-dehydro-L-proline, (2S, 4S)-4-hydroxy-L-proline, (2S, 4R)-4-hydroxy-L-proline, (2S,4S)-4-azido-L-proline, (2S)-4,4-difluoro-L-proline, (2S)-azetidine-2-carboxylic acid, (2S)-piperidine-2-carboxylic acid, or (4R)-1,3-thiazolidine-4-carboxylic acid can be used in the molecular architecture that is conjugated to insulin.

It is to be understood that in some embodiments, a specific orientation of amino acids is achieved using, for example, methods of Albericio, F. (2000). *Solid-Phase Synthesis: A Practical Guide* (1 ed.). Boca Raton: CRC Press. p. 848. In some embodiments a compound of the present disclosure, such as a compound of Formula I or Formula II, can bind to a diol, a catechol, a hexose sugar, glucose, xylose, fucose, galactosamine, glucosamine, mannosamine, galactose, mannose, fructose, galacturonic acid, glucuronic acid, iduronic acid, mannuronic acid, acetyl galactosamine, acetyl glucosamine, acetyl mannosamine, acetyl muramic acid, 2-keto-3-deoxy-glycero-galacto-nonionic acid, acetyl neuraminic acid, glycolyl neuraminic acid, a neurotransmitter, dopamine, or a disaccharide or polymer of saccharides or diols.

In some embodiments, modifications or intermediates may include the use of an N-methyliminodiacetic acid (MIDA) group to make a MIDA conjugated boronate or a MIDA boronate; such modifications can be used during preparation of boronates towards the final structures of use (e.g., in embodiments of methods for preparing the conjugates described herein). In some embodiments boronic acid pinacol esters are used towards the final structures wherein the pinacol group can be readily removed using standard techniques by one skilled in the art. The MIDA-protected boronate esters are easily handled, stable under air, compatible with chromatography, and unreactive under standard anhydrous cross-coupling conditions and easily deprotected at room temperature under mild aqueous basic conditions such as 1M NaOH, or even NaHCO$_3$, or as described by Lee, S. J. et al. (2008). *J. Am. Chem. Soc.* 130:466.

The biological mechanism by which wild type insulin binds to the insulin receptor is previously reported in Menting, J. G. et al. (2013). *Nature* 493, 241-245; and Menting, J. G. et al. (2014). "Protective hinge in insulin opens to enable its receptor engagement." *Proc. Natl. Acad. Sci. U.S.A.* 111, E3395-3404. The activity of such insulin can be measured using any suitable technique, for example, by using in vitro insulin receptor binding with TyrA14-$^{125}$I human insulin as tracer and utilizing antibody binding beads with an insulin receptor monoclonal antibody. In some embodiments, animal models can be used for in vivo assessment of insulin activity during glucose challenge using methods that are known to one skilled in the art. In some embodiments, a compound disclosed herein is partially or fully expressed along with a recombinant protein of interest such as insulin. The processes for expression of insulin in *E. coli* are known and can be easily performed by one skilled in the art e.g., by using the procedures outlined in Jonasson (1996). *Eur. J. Biochem.* 236:656-661; Cowley (1997). *FEBS Lett.* 402:124-130; Cho (2001). *Biotechnol. Bioprocess Eng.* 6: 144-149; Tikhonov (2001). *Protein Exp. Pur.* 21: 176-182; Malik (2007). *Protein Exp. Pur.* 55: 100-111; and Min (2011). *J. Biotech.* 151:350-356. In the most common process, the protein is expressed as a single-chain proinsulin construct with a fission protein or affinity tag. The compound (e.g., a compound of Formula I) that includes Z1a when Z1a is present can be expressed as part of proinsulin, then modified chemically to conjugate, through amide linkages, to structures of interest. This approach provides good yield and reduces experimental complexity by decreasing the number of processing steps and allows refolding in a native-like insulin, see for example, Jonasson, *Eur. J. Biochem.* 236:656-661 (1996); Cho, *Biotechnol Bioprocess Eng.* 6: 144-149 (2001); Tikhonov, *Protein Exp. Pur.* 21:176-182 (2001); Min, *J. Biotech.* 151:350-356 (2011)). When expressed in *E. coli*, proinsulin is usually found in inclusion bodies and can be easily purified by one skilled in the art.

In some embodiments, proinsulin can be expressed using standard IPTG (isopropylthio-β-galactoside) induction of IPTG inducible expression constructs and vectors in *E. coli* strains such as B21 strain. As an example, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired proinsulin can be performed via known procedures in the art. See, e.g., U.S. Pat. Nos. 5,457,066, 5,700,662, 5,514,646, 9,050,371, and 10400021.

In some embodiments, a compound of the present disclosure (e.g. Formula I, Formula II) may be formulated for injection. For example, it may be formulated for injection into a subject, such as a human. In some embodiments, the composition may be a pharmaceutical composition, such as a sterile, injectable pharmaceutical composition. In some embodiments, the composition may be formulated for subcutaneous injection. In some embodiments, the composition is formulated for transdermal, intradermal, transmucosal, nasal, inhalable or intramuscular administration. In some embodiments, the composition may be formulated in an oral dosage form or a pulmonary dosage form. Pharmaceutical compositions suitable for injection may include sterile aqueous solutions containing, for example, sugars, polyalcohols such as mannitol and sorbitol, phenol, meta-cresol, and sodium chloride and dispersions may be prepared in glycerol, liquid polyethylene glycols, and mixtures thereof and in oils and the carrier can, for example, be a solvent or dispersion medium containing, for example, water, saccharides, ethanol, polyol (for example, glycerol, propylene glycol, and liquid polyethylene glycol, and the like), and suitable mixtures thereof. One skilled in the art recognizes that specific formulations can be developed to best suit the application and method of use of the molecular architectures of the invention. General considerations in the formulation and manufacture of pharmaceutical compositions, routes of administrating and including suitable pharmaceutically acceptable carriers may be found, for example, in *Remington's Pharmaceutical Sciences*, 19th ed., Mack Publishing Co., Easton, Pa., 1995. In some embodiments, the pharmaceutical composition may include zinc, e.g., $Zn^{2+}$ along with insulin if the compound (e.g. a compound of Formula I) comprises insulin. Such zinc formulations are, for example, described in U.S. Pat. No. 9,034,818. For example, the pharmaceutical composition may comprise zinc at a molar ratio to the modified insulin of about M:N where M is 1-11 and N is 6-1. In some embodiments, such modified insulins may be stored in a pump, and that pump being either external or internal to the body releases the modified insulins. In some embodiments, a pump may be used to release a constant amount of modified insulin wherein the insulin is glucose responsive and can automatically adjust activity based on the levels of glucose in the blood and/or the release rate from the injection site. In some embodiments, the compositions may be formulated in dosage unit form for ease of administration and uniformity of dosage. In some embodiments, the pharmaceutical composition may further include a second insulin type to provide fast-acting or basal-insulin in addition to the effect afforded by the molecular architecture. In some embodiments, a compound of the present disclosure (e.g., a compound of Formula I) is injected separately from insulin but modulates the activity of insulin by binding to insulin, and in some embodiments this activity change is dependent on glucose.

In some embodiments, the pharmaceutical composition comprises one or more of the compounds disclosed herein and at least one additional component selected from pharmaceutically acceptable carriers, pharmaceutically acceptable vehicles, and pharmaceutically acceptable excipients. In some embodiments, the pharmaceutical composition comprises a compound of Formula I and at least one additional component selected from pharmaceutically acceptable carriers, pharmaceutically acceptable vehicles, and pharmaceutically acceptable excipients.

In some embodiments, the present disclosure includes compounds that can be part of a kit, wherein the kit includes a compound of Formula I comprising modified insulin, as well as a pharmaceutically acceptable carrier, and for injections may include a syringe or pen. In some embodiments, a kit may include a syringe or pen that is pre-filled with a pharmaceutical composition that includes the compound of Formula I with a liquid carrier. Alternatively, a kit may include a separate container such as a vial with a pharmaceutical composition that includes the compound of Formula I with a dry carrier and an empty syringe or pen. In some embodiments, such a kit may include a separate container that has a liquid carrier, which can be used to reconstitute a given composition that can then be taken up into the syringe or pen. In some embodiments, a kit may include instructions. In some embodiments, the kit may include blood glucose measuring devices that either locally or remotely calculate an appropriate dose of the modified insulin that is to be injected at a given point in time, or at regular intervals. Such a dosing regimen is unique to the patient and may, for example, be provided as instruction to program a pump either by a person or by a computer. The kit may include an electronic device which transfers blood glucose measurements to a second computer, either locally or elsewhere (for example, in the cloud) which then calculate the correct amount of compound of Formula I comprising, e.g., a modified insulin that needs to be used by the patient at a certain time.

In some embodiments, the invention relates to a method for treating a disease or condition in a subject, comprising administering to the subject a composition including a compound described herein. In some embodiments, the disease or condition may be hyperglycemia, type 2 diabetes, impaired glucose tolerance, type 1 diabetes, obesity, metabolic syndrome X, or dyslipidemia, diabetes during pregnancy, pre-diabetes, Alzheimer's disease, MODY 1, MODY 2 or MODY 3 diabetes, mood disorders and psychiatric disorders. It will be appreciated that this combination approach may also be used with insulin resistant patients who are receiving an insulin sensitizer or a secondary drug for diabetes (such as, for example, a biguanide such as metformin, a glitazone) or/and an insulin secretagogue (such as, for example, a sulfonylurea, GLP-1, exendin-4 etc.) or amylin.

In some embodiments, a compound of the present disclosure (e.g. a compound of Formula I) may be administered to a patient who is receiving at least one additional therapy or taking at least one additional drug or therapeutic protein. In some embodiments, the at least one additional therapy is intended to treat the same disease or disorder as the administered compound (e.g. a compound of Formula I). In some embodiments, the at least one additional therapy is intended to treat a side-effect of the compound (e.g. a compound of Formula I) or as an adjuvant. The timeframe of the two therapies may differ or be the same; they may be administered on the same or different schedules as long as there is a period when the patient is receiving a benefit from both therapies. The two or more therapies may be administered within the same or different formulations as long as there is a period when the patient is receiving a benefit from both therapies. Any of these approaches may be used to administer more than one anti-diabetic drug to a subject.

In some embodiments a therapeutically effective amount of the compound (e.g. a compound of Formula I) which is sufficient amount to treat (meaning for example to ameliorate the symptoms of, delay progression of, prevent recurrence of, or delay onset of) the disease or condition at a reasonable benefit to risk ratio will be used. In some embodiments, this may involve balancing of the efficacy and additional safety to toxicity. By additional safety, it is meant that, for example, the compound (e.g. a compound of Formula I) can be responsive to changes in blood glucose levels or level of other molecules, even when the patient is not actively monitoring the levels of that molecule, such as blood glucose levels at a given timeframe, for example during sleep. In some embodiments, therapeutic efficacy and toxicity may be determined by standard pharmacological procedures in cell cultures or in vivo with experimental animals, and for example measuring $ED_{50}$ and $LD_{50}$ for therapeutic index of the drug. In some embodiments, the average daily dose of insulin with the molecular architecture is in the range of 5 to 400 U, (for example 30-150 U where 1 Unit of insulin is about 0.04 mg). In some embodiments, an amount of compound (e.g. a compound of Formula I) with these insulin doses is administered on a daily basis or bi-daily basis or by every three days or by every 4 days. In some embodiments, the basis is determined by an algorithm, which can be computed by a computer. In some embodiments, an amount of compound, such as a compound of Formula I, with 5 to 10 times these doses is administered on a weekly basis or at regular intervals. In some embodiments, an amount of conjugate with 10 to 20 times these doses is administered on a bi-weekly basis or at regular intervals. In some embodiments, an amount of compound (e.g. a compound of Formula I) with 20 to 40 times these doses is administered on a monthly basis or at regular intervals. In some embodiments, the C-terminus of the A-chain of insulin may be further extended with a peptide (amino acid sequence) including 1-20 amino acid residues. In some embodiments, the insulin analogue is a desB30 insulin.

In some embodiments, Z1a is an amino acid or a peptide. In at least some embodiments, the Z1a includes (is composed of) 1-50 amino acid residues, for example, 1 residue, 50 residues, or any intermediate number of residues (such as e.g., 10, 15, 25, 30, 42 residues, etc.). In some embodiments, the Z1a includes 1-15 amino acids. In at least some embodiments, the peptide Z1a includes 1-8 amino acids. In some embodiments, Z1a includes 5 to 6 amino acids. In some embodiments, Z1a comprises at least one amino acid independently selected from: Alanine (A), Asparagine (N), Glutamine (Q), Threonine (T), Methionine (M), Histidine (H), Cysteine (C), Valine (V), Isoleucine (I), Lysine (K), and Leucine (L), and the rest of the amino acids are each independent selected from any of the twenty naturally occurring amino acids. In some embodiments, Z1a may include diaminopropionic acid, diaminobutyric acid, or ornithine.

In some embodiments, Z1a includes 1 to 5 lysine residues (K). In some embodiments, Z1a includes 1 to 3 K amino acids. In some embodiments Z1a includes 5 to 6 amino acids and at least one or more amino acids are K. In some embodiments, Z1a includes 5 to 6 amino acids and 1 to 3 amino acids are K.

In some embodiments Z1a is appended to the N-terminus and/or C-terminus, and/or inserted into the sequence of the A-chain or B-chain of insulin.

Compounds

In some embodiments, provided herein are compounds of Formula I, or a stereoisomer or a mixture of stereoisomers, or pharmaceutically acceptable salt thereof:

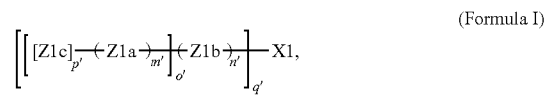

(Formula I)

wherein:
  X1 comprises:
    i. a drug substance comprising an amine;

ii. an amine configured to be covalently conjugated to a drug substance; or
iii. NH$_2$ or OH (e.g. X1 is NH$_2$ or OH);
   each Z1a independently comprises 1 to 50 amino acids connected together using amide or peptide bonds;
   each Z1b is independently a small-molecule linker;
   each Z1c is independently selected from Formulae FF12, FF12A, FF12B, FF12C, FF12D, FF114, FF114A, FF114B, FF115, FF115A, FF115B, FF116, FF116A, FF116B, FF116C, FF116D, FF117, FF193A, FF203, FF225, FF225A, FF225B, and FF226, wherein each Z1c is covalently conjugated either directly or via an indirect linker to an amine of Z1a or to an amine of X1 or to NH$_2$ when X1 is NH$_2$ or to OH when X1 is OH;
   each m' is 0 or 1;
   each n' is 0;
   each o' is 1;
   each p' is 1, 2, 3, 4, 5, 6, 7, 8, 9, or 10; and
   each q' is 1, 2, 3, 4, or 5, wherein when p' or q' is 2 or more, each corresponding Z1c is independently selected and may be the same or different and wherein when q' is 2 or more, each corresponding Z1a is independently selected and may be the same or different; and
   when m'=0, each Z1c is covalently conjugated either directly or via an indirect linker to an amine of X1 or to NH$_2$ when X1 is NH$_2$ or to OH when X1 is OH, and for m'=1 each Z1a is covalently conjugated via an amide or peptide bond to X1 and each Z1c is covalently conjugated either directly or via an indirect linker to an amine of Z1a or to X1.

In some embodiments, the compound is selected from a compound represented by Formula I, a stereoisomer thereof, a mixture of stereoisomers thereof, and pharmaceutically acceptable salt thereof, with the proviso that the compound is not any of Examples 1-880 disclosed in PCT/US2021/059802.

In some embodiments, X1 is a polypeptide comprising an insulin receptor agonist having an A-chain and a B-chain.

In some embodiments, the present disclosure is directed to a compound of the following formula, or a stereoisomer or a mixture of stereoisomers, or a pharmaceutically acceptable salt thereof:

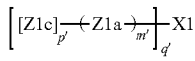

wherein:
X1 comprises a polypeptide comprising an insulin receptor agonist having an A-chain and a B-chain;
each Z1a independently comprises 1 to 50 amino acids connected together using amide or peptide bonds;
each Z1c is independently selected from Formulae FF12A, FF12B, FF114A, FF115A, FF116A, and FF225A, wherein each Z1c is covalently conjugated either directly or via an indirect linker to an amine of Z1a or to an amine of X1 or to OH when X1 is OH;
each m' is 0 or 1;
each p' is 1, 2, 3, 4, or 5; and each q' is 1, 2, 3, 4, or 5, wherein when p' or q' is 2 or more, each corresponding Z1c is independently selected and may be the same or different and wherein when q' is 2 or more, each corresponding Z1a is independently selected and may be different;
when m'=0, each Z1c is covalently conjugated either directly or via an indirect linker to an amine of X1 or to OH when X1 is OH, when m'=1 each Z1a is covalently conjugated via an amide or peptide bond to X1 and each Z1c is covalently conjugated either directly or via an indirect linker to an amine of Z1a; and
wherein one or more positions of the compound may comprise an isotope.

In some embodiments, at least one Z1c comprises an alpha methyl group or a beta methyl group. In some embodiments, Z1c comprises an alpha methyl group. In some embodiments, Z1c comprises a beta methyl group.

In some embodiments, the compound comprises:
at least one Z1c is covalently conjugated via the indirect linker to an amine of X1 or to NH$_2$ when X1 is NH$_2$ or to OH when X1 is OH or to an amine of Z1a,
the indirect linker is represented by Formula (X")$_{n1}$, wherein
each n1 is independently selected from 1, 2, 3, 4, and 5, and
each X" is independently selected from:
i. an L- or D-amino acid, wherein an amine functional group of the L- or D-amino acid is covalently conjugated, directly or indirectly, to Z1c and an acid functional group of the L- or D-amino acid is conjugated, directly or indirectly, to X1 or to Z1a; and
ii. Formulae FL(IA), FL(IB), FL69, and FL70;
   wherein Formula FL(IA) and FL(IB) are:

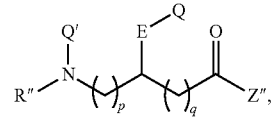
FL(IA)

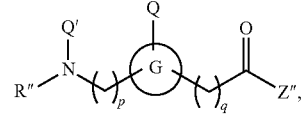
FL(IB)

and stereoisomers thereof;
wherein:
G is selected from a 3- to 6-membered cycloalkyl group, a 3- to 10-membered heterocyclyl group, a heteroaryl group, and an aryl group, wherein each group is optionally substituted with 1-3 groups independently selected from hydroxy, amino, halogen, cycloalkyl (e.g., (C$_3$-C$_6$)cycloalkyl), alkoxy, and alkyl (e.g., C$_1$-C$_6$alkyl);
E is absent or is an alkylene group optionally substituted with 1-3 groups independently selected from halogen, hydroxy, and amino;
Q is absent or is selected from hydrogen, alkyl (e.g., C$_1$-C$_6$alkyl), halo, cyano, alkoxy, carboxylic acid, amino, hydroxy, amide, halo alkyl (e.g., C$_1$-C$_6$haloalkyl), cycloalkyl (e.g., (C$_3$-C$_6$)cycloalkyl), heterocycle, heteroaryl, and aryl, wherein the alkyl, alkoxy, cycloalkyl, heterocycle, heteroaryl, and aryl is each optionally substituted with 1-5 groups independently selected from alkyl (e.g., $C_1$-$C_6$alkyl), amino, amide, halo, hydroxy, cyano, halo alkyl (e.g., $C_1$-$C_6$haloalkyl), and alkoxy;

Q' is selected from hydrogen, alkyl (e.g., $C_1$-$C_6$alkyl), and an acyl group;

Q and Q', together with the carbon and nitrogen atom to which they are attached, optionally form a 4-membered heterocyclyl, a 5-membered heterocyclyl, a 6-membered heterocyclyl, a 9-membered bicyclic heterocyclyl, or a 10-membered bicyclic heterocyclyl, wherein the 4-membered heterocyclyl, 5-membered heterocyclyl, 6-membered heterocyclyl, 9-membered bicyclic heterocyclyl, and 10-membered bicyclic heterocyclyl are each optionally substituted with 1-5 groups independently selected from alkyl (e.g., $C_1$-$C_6$alkyl), amino, halo, hydroxy, cyano, amide, halo alkyl (e.g., $C_1$-$C_6$haloalkyl), and alkoxy;

p is 0, 1, 2, 3, 4, or 5;

q is 0, 1, 2, 3, 4, or 5;

R" represents a covalent bond, directly or indirectly, to Z1c;

Z" represents a covalent bond, directly or indirectly, to X1 or to Z1a; and any primary amine is optionally acetylated or alkylated;

wherein Formulae FL69, and FL70 are:

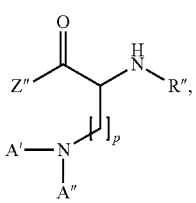

FL69

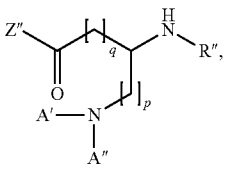

FL70 and stereoisomers thereof; wherein:

R" represents a covalent bond, directly or indirectly, to Z1c;

Z" represents a covalent bond, directly or indirectly, to X1 or to Z1a;

A' is selected from H, an alkyl (e.g., $C_1$-$C_6$alkyl), a saturated fatty acid, an unsaturated fatty acid, a cycloalkyl (e.g., $(C_3$-$C_6)$cycloalkyl), a haloalkyl (e.g., $C_1$-$C_6$ haloalkyl), an aryl, and a heteroaryl; and A" is selected from an alkyl (e.g., $C_1$-$C_6$alkyl), a substituted acyl, acyl terminating in an acid, a saturated or unsaturated fatty acid, a cycloalkyl (e.g., $(C_3$-$C_6)$cycloalkyl), a haloalkyl (e.g., $C_1$-$C_6$haloalkyl), an aryl, and a heteroaryl;

p is 1, 2, 3, 4, or 5, q is 1, 2, 3, 4, or 5, and any primary amine is optionally acetylated or alkylated.

In some embodiments, the compound comprises:

at least one Z1c covalently conjugated via the indirect linker to X1 or to Z1a, wherein the indirect linker is represented by Formula $(X")_{n1}$, each n1 is independently selected from 1, 2, 3, 4, or 5, and each X" is independently selected from:

an L- or D-amino acid, wherein an amine functional group of the L- or D-amino acid is covalently conjugated, directly or indirectly, to Z1c and an acid functional group of the L- or D-amino acid is conjugated, directly or indirectly, to X1 or to Z1a; and Formulae FL(IA), FL(IB), FL69, and FL70, wherein Formulae FL(IA) and FL(IB) are selected from Formulae FL3, FL5, FL5A, FL5B, FL20-FL68, and FL71-FL75:

(FL3)

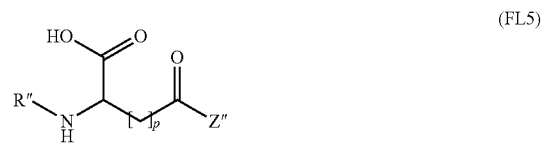

(FL5)

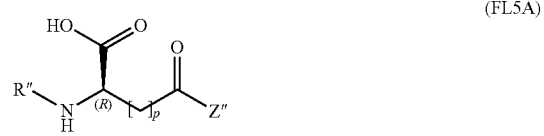

(FL5A)

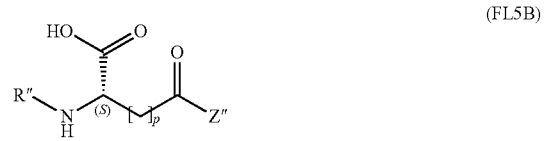

(FL5B)

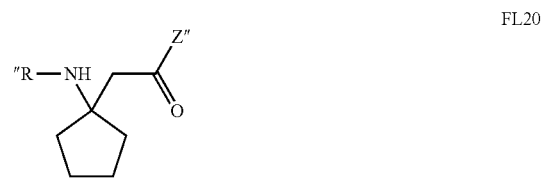

FL20

FL21

FL22

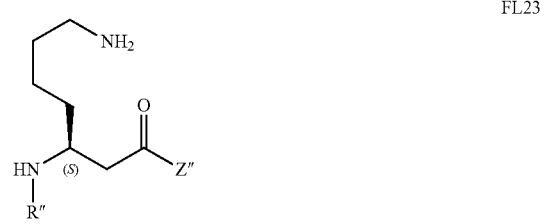

FL23

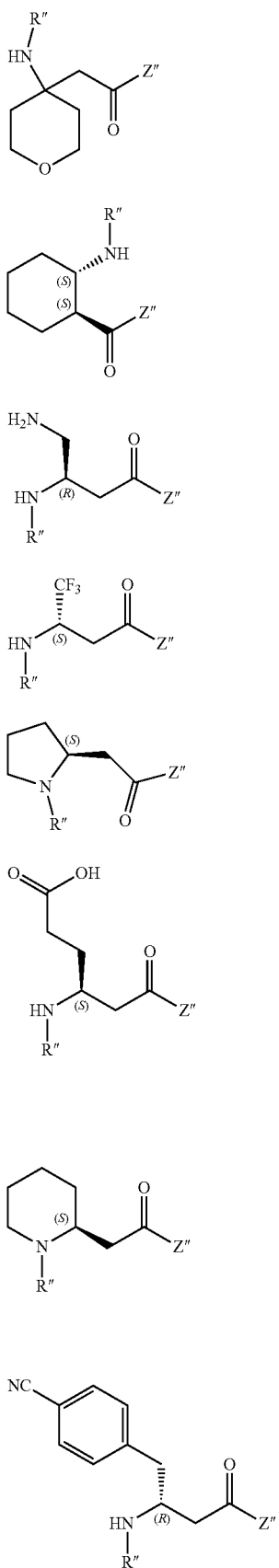
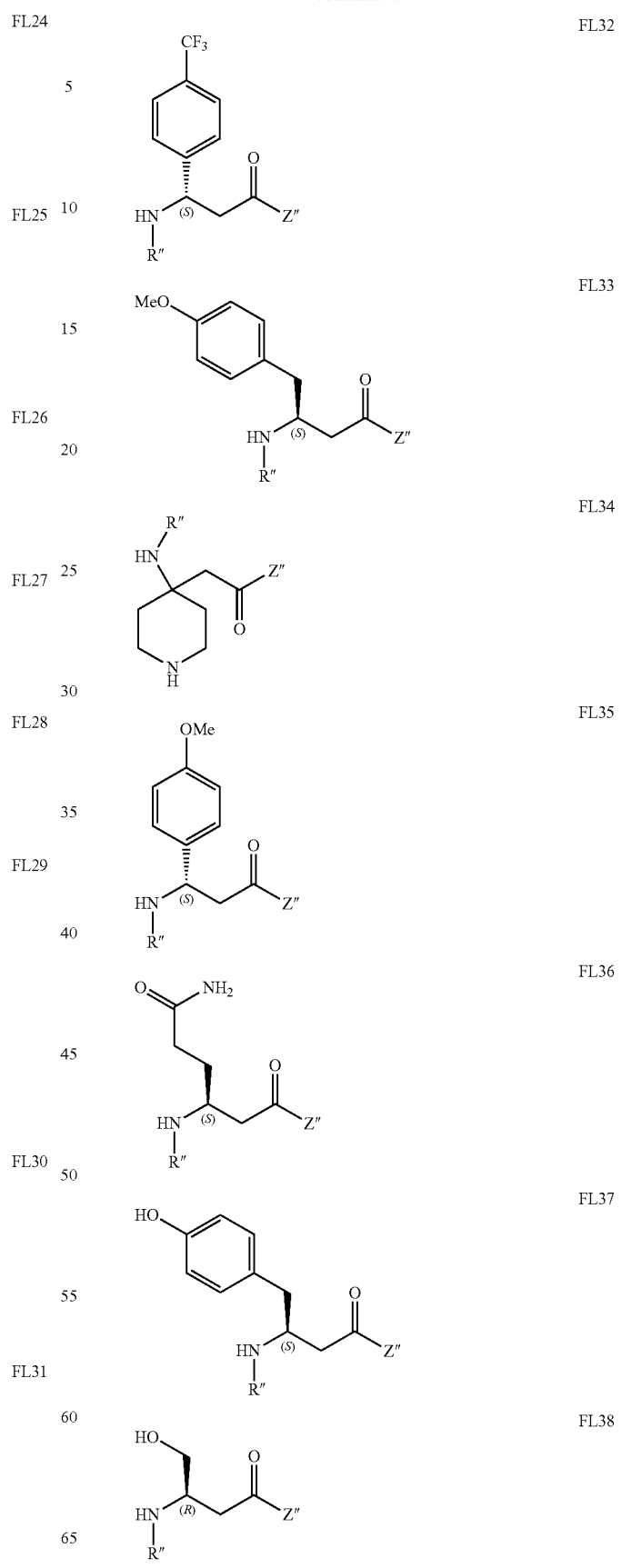

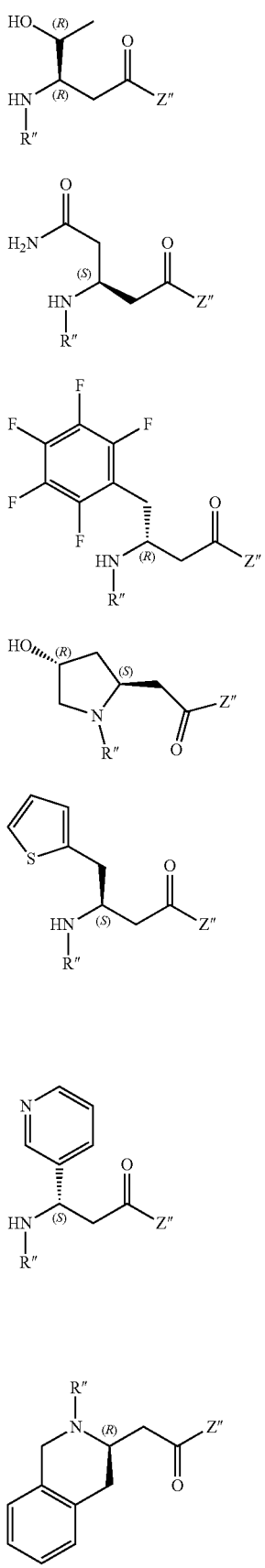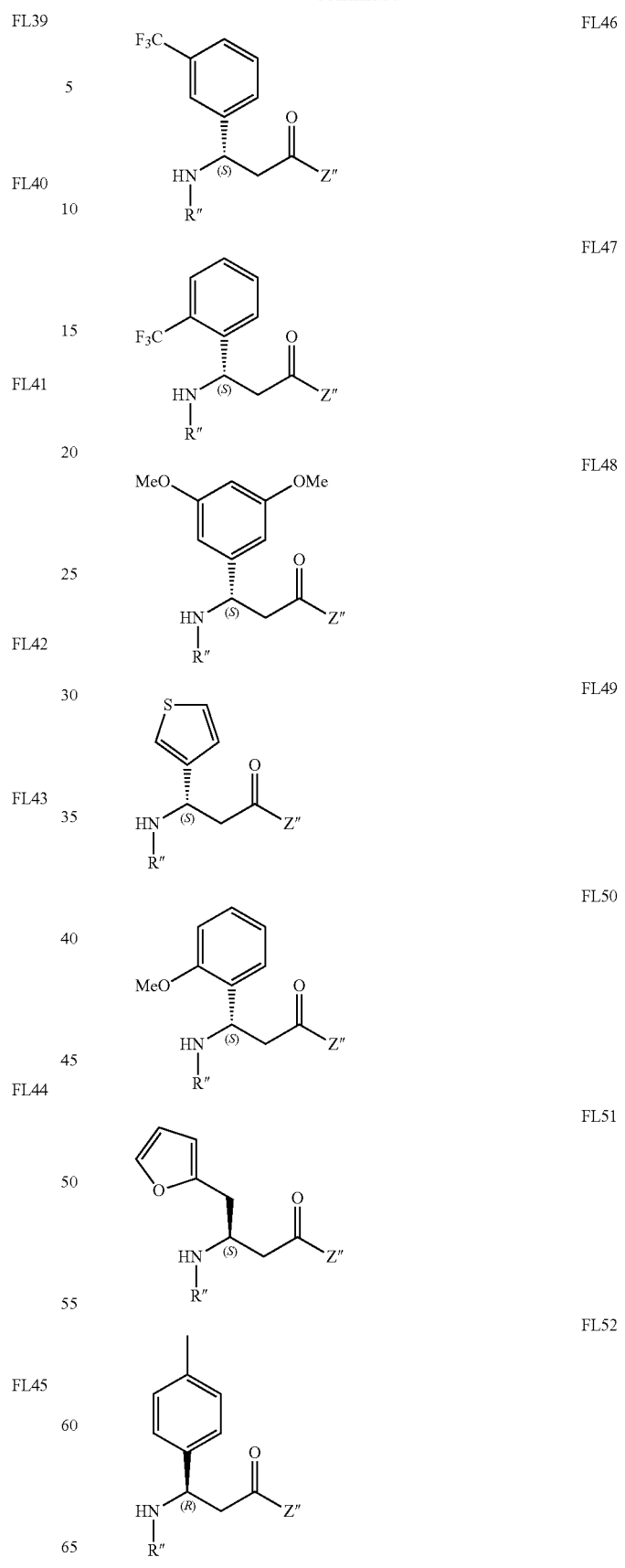

FL53 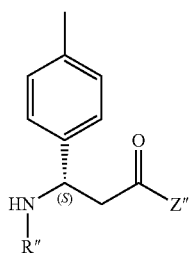
FL54 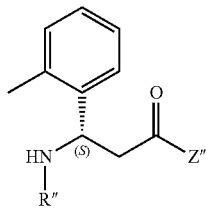
FL55 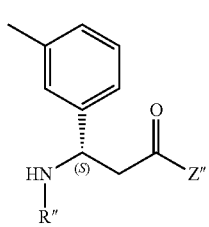
FL56 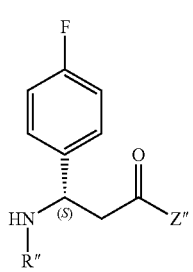
FL57 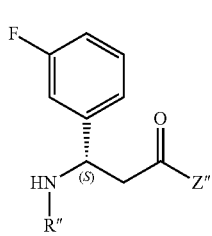
FL58 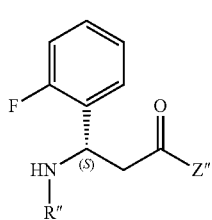
FL59 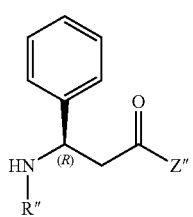
FL60 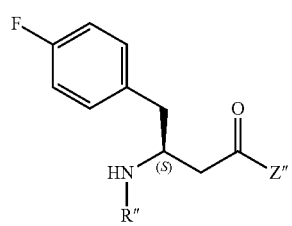
FL61 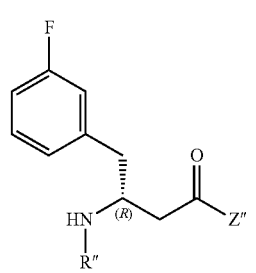
FL62 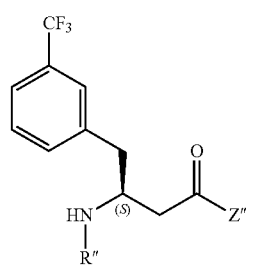
FL63 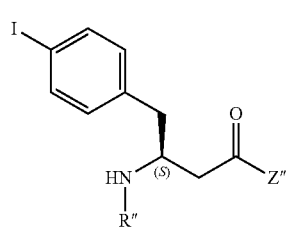
FL64 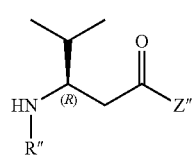
FL65 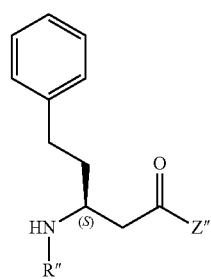

-continued

FL66
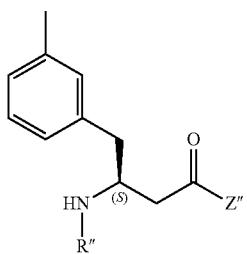

FL67
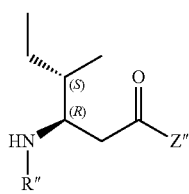

FL68
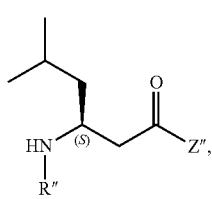

FL71
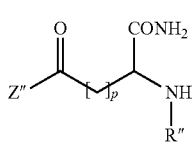

FL72
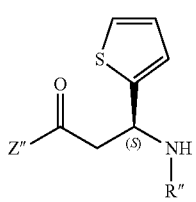

FL73
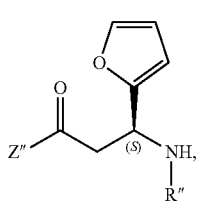

FL74
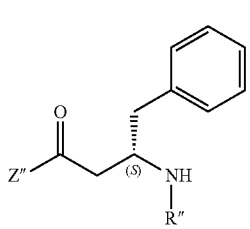

FL75
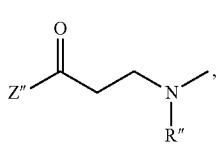

and stereoisomers thereof;
wherein:
p is 1, 2, 3, 4, or 5,
q is 1, 2, 3, 4, or 5, and
any primary amine is optionally acetylated or alkylated.

Wherein Formulae FL69, and FL70 are:

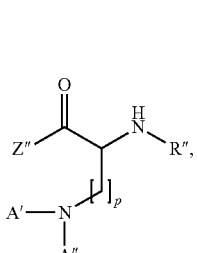

FL69

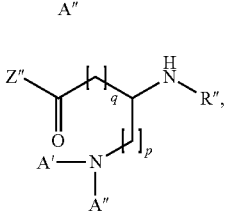

FL70 and stereoisomers thereof; wherein:

R″ represents a covalent bond, directly or indirectly, to Z1c;

Z″ represents a covalent bond, directly or indirectly, to X1 or to Z1a;

A′ is selected from H, an alkyl group (e.g., $C_1$-$C_6$alkyl group), a saturated or unsaturated fatty acid, a cycloalkyl group (e.g., $C_3$-$C_6$cycloalkyl group), a haloalkyl group (e.g., $C_1$-$C_6$haloalkyl group), an aryl group, and a heteroaryl group; and A″ is selected from alkyl group (e.g., $C_1$-$C_6$alkyl group), a substituted acyl group, acyl group terminating in an acid group, a saturated or unsaturated fatty acid, a cycloalkyl group (e.g., ($C_3$-$C_6$)cycloalkyl group), a haloalkyl group (e.g., $C_1$-$C_6$haloalkyl group), an aryl group, and a heteroaryl group;

p is 1, 2, 3, 4, or 5, q is 1, 2, 3, 4, or 5, and any primary amine is optionally acetylated or alkylated.

In some embodiments, the stereochemistry of FL70 can be S or R at the stereogenic carbon. In some embodiments, the stereochemistry of FL70 is S at the stereogenic carbon. In some embodiments, the stereochemistry of FL70 is R at the stereogenic carbon.

In some embodiments, n1 is 1.

In some embodiments, the compound is represented by Formula IC:

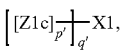

IC each p′ is 1, 2, 3, or 4; and each q′ is 1, 2, 3, 4, or 5.

In some embodiments, each B1 and B2 is independently selected from Formulae F2, F5, and F10, wherein Formulae F2, F5, and F10 are:

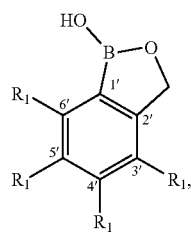
(F2)

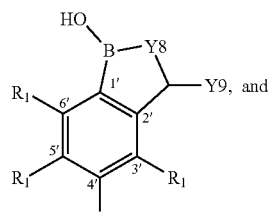
(F5)

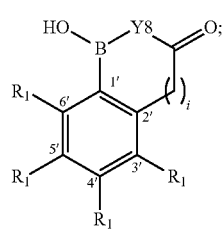
(F10)

wherein:
one $R_1$ represents (C=O)---* or $(CH_2)_m$(C=O)---*, wherein ---* represents the attachment point to the rest of Z1c, and m is 1, 2, 3, 4, 5, 6, or 7; and
each remaining $R_1$ is independently selected from H, F, Cl, Br, I, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_{m''}CH_3$, $(SO_2)NH$—$CH_3$, $(SO_2)NH(CH_2)_{m''}CH_3$, and $OCF_3$, wherein m'' is 1, 2, 3, 4, 5, 6, or 7;
Y8 is O, N, or NR, wherein R is an alkyl group (e.g., $C_1$-$C_6$alkyl group) or H;
Y9 is H, $CH_3$, or an alkyl group (e.g., $C_1$-$C_6$alkyl group), provided that when Y8 is O, the Y9 is a $CH_3$ or an alkyl group (e.g., $C_1$-$C_6$alkyl group); and
i is 1, 2, or 3.

In some embodiments, the B1 and the B2 are selected from Formula F2, and each remaining R1 is independently selected from H, $CF_3$ and F; and either each remaining $R_1$ is H, or one or two of the each remaining $R_1$ is F or $CF_3$.

In some embodiments, the at least one Z1c is selected from FF12, FF12A-D, FF116, and FF116A-D. In some embodiments, both B1 and B2 are selected from F2, wherein all remaining R1 are H; and the indirect linker is selected from a relatively hydrophobic indirect linker. In some embodiments, the relatively hydrophobic indirect linker may be selected from FL3, FL20-22, FL25, FL27-28, FL30-33, FL35, FL37, FL41, FL43-70, and amino acids having a hydrophobic side chain. In some embodiments, both B1 and B2 are selected from F2, wherein one of the remaining R1 is $CF_3$ and the remaining R1 is H; and the indirect linker is selected from a relatively hydrophilic indirect linker. In some embodiments, the relatively hydrophilic indirect linker may be selected from FL5, FL5A, FL5B, FL23-24, FL26, FL29, FL34, FL36, FL38-40, FL42, and amino acids having a hydrophilic side chain.

In some embodiments, each Z1c is covalently conjugated to an indirect linker and each of the Z1c and the indirect linker in combination (i.e., a Z1c-Linker) is selected from Formulae FFL-1 to FFL-101:

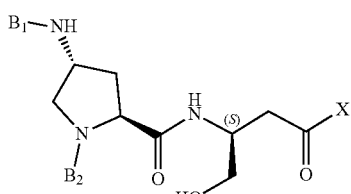
FFL-1

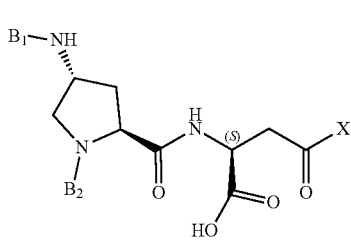
FFL-2

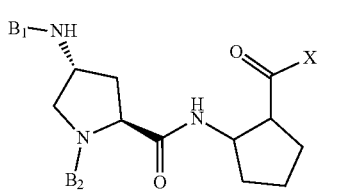
FFL-3

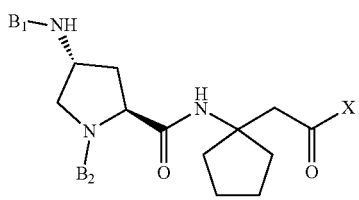
FFL-4

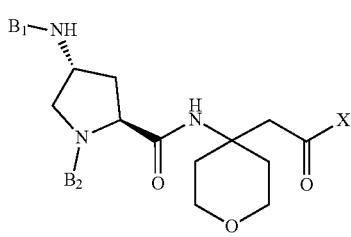
FFL-5

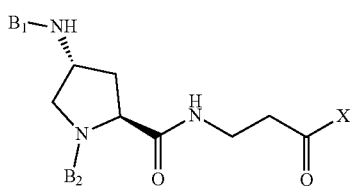
FFL-6

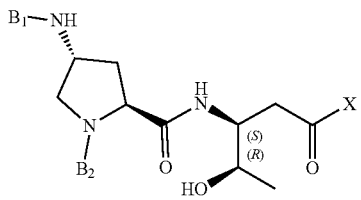
FFL-7

-continued
FFL-8
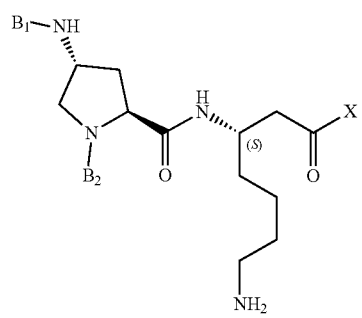
FFL-14
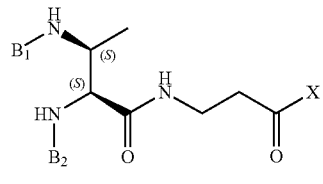
FFL-9
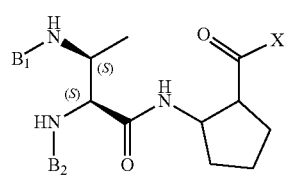
FFL-15
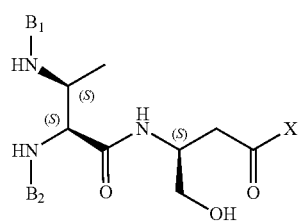
FFL-10
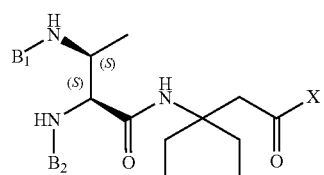
FFL-16
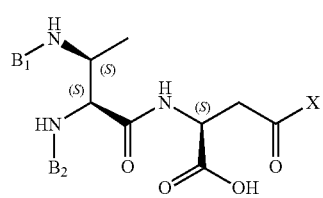
FFL-11
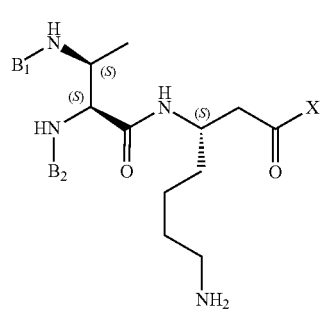
FFL-17
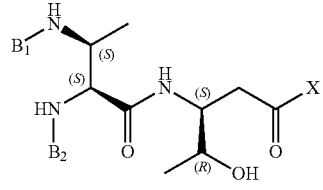
FFL-18
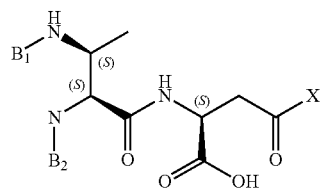
FFL-12
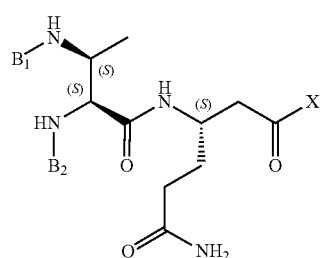
FFL-19
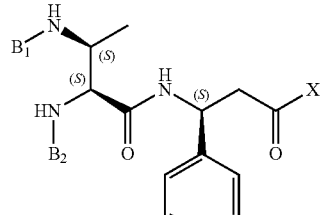
FFL-13
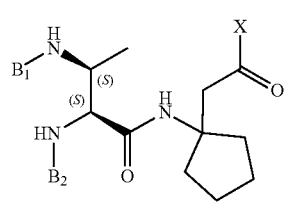
FFL-20
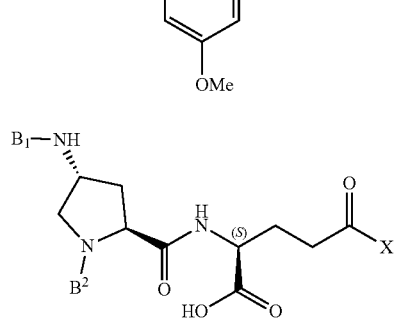

FFL-21
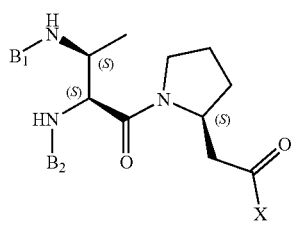
FFL-22
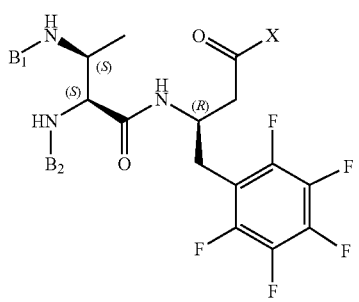
FFL-23
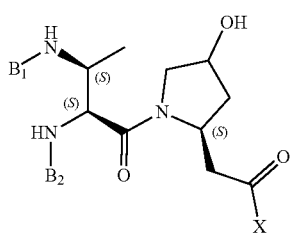
FFL-24
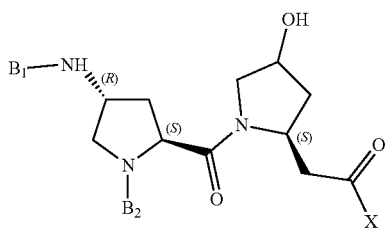
FFL-25
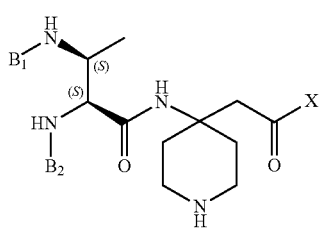
FFL-26
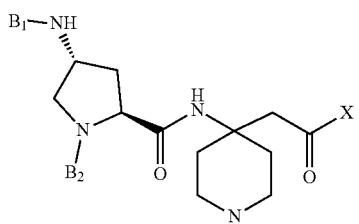
FFL-27
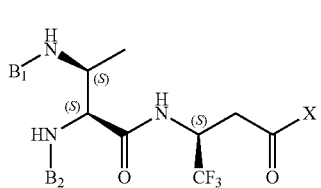
FFL-28
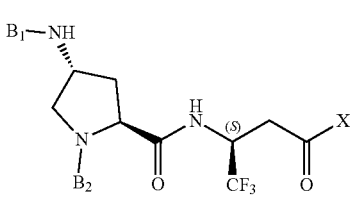
FFL-29
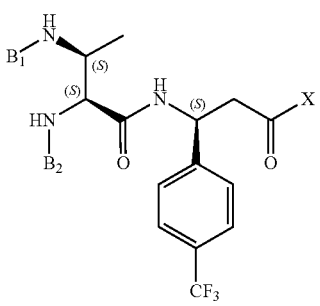
FFL-30
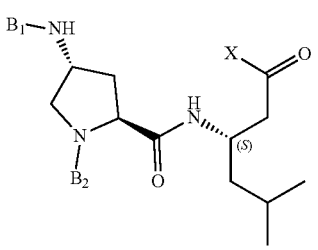
FFL-31
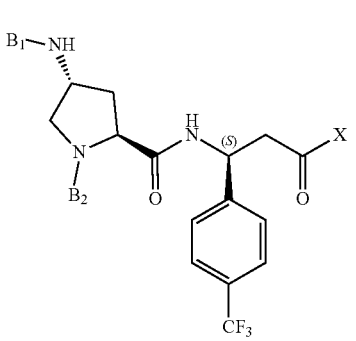
FFL-32
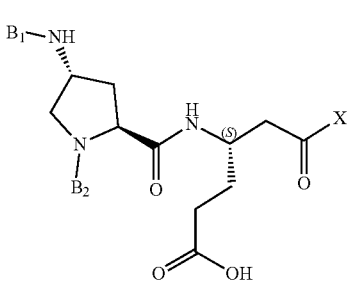
FFL-33
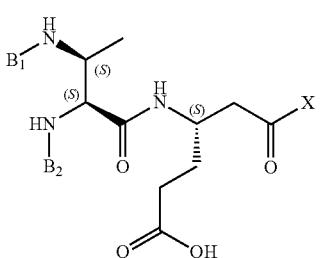

FFL-34
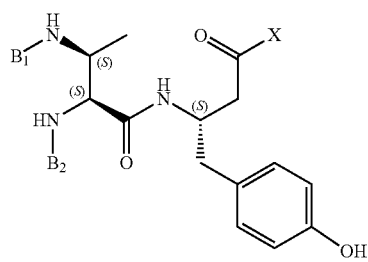
FFL-35
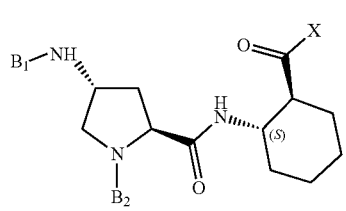
FFL-36
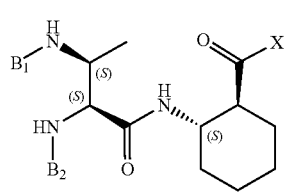
FFL-37
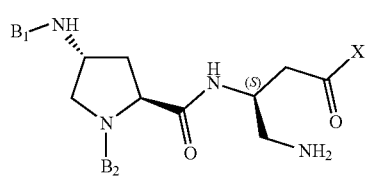
FFL-38
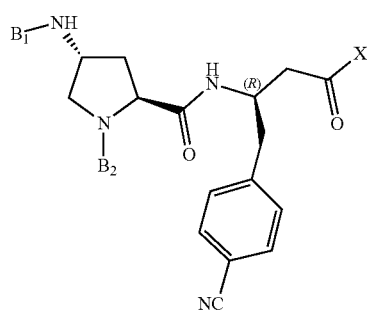
FFL-39
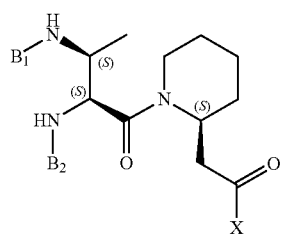
FFL-40
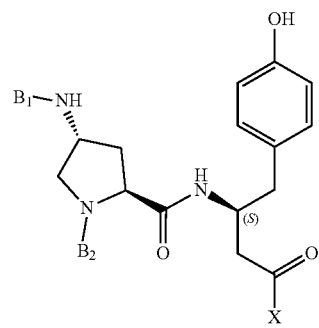
FFL-41
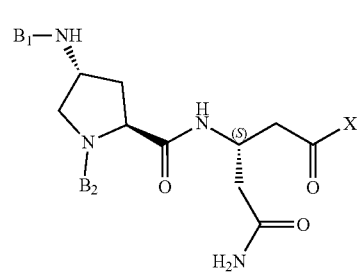
FFL-42
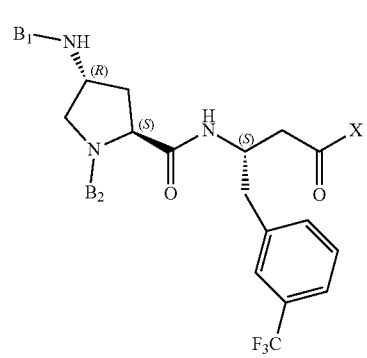
FFL-43
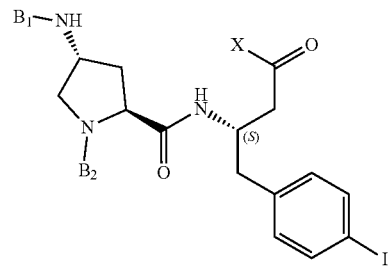
FFL-44
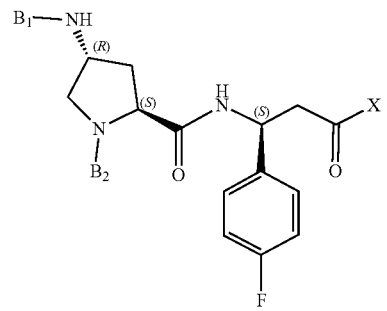

FFL-45
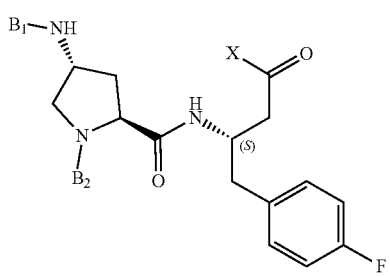
FFL-46
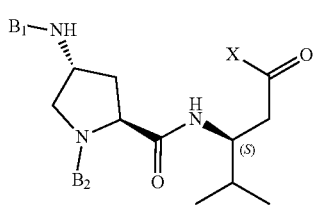
FFL-47
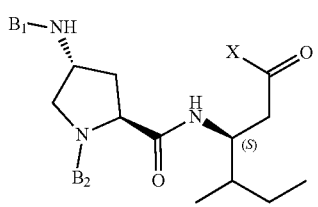
FFL-48
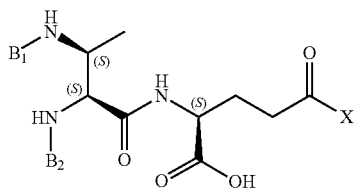
FFL-49
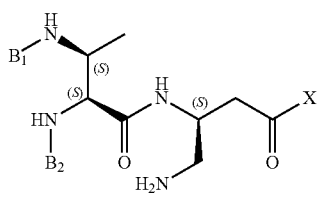
FFL-50
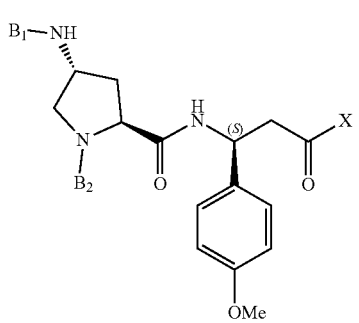
FFL-51
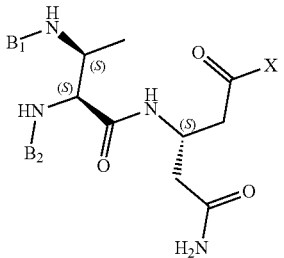
FFL-52
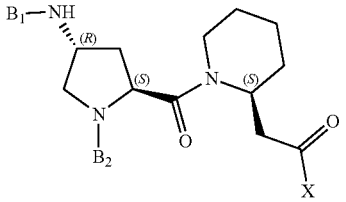
FFL-53
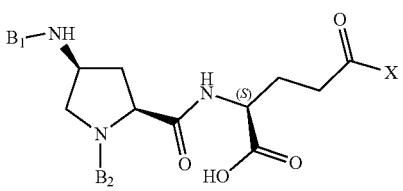
FFL-54
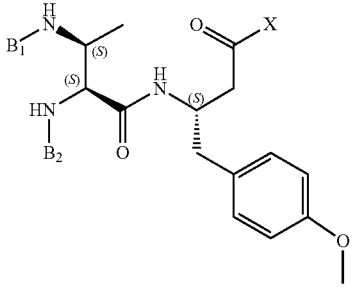
FFL-55
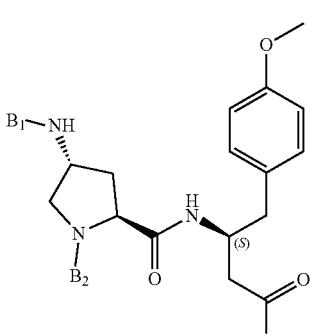
FFL-56
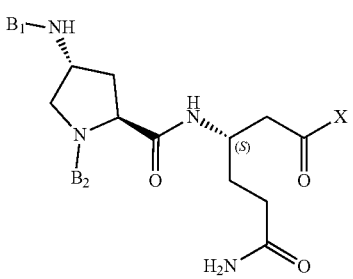

FFL-57
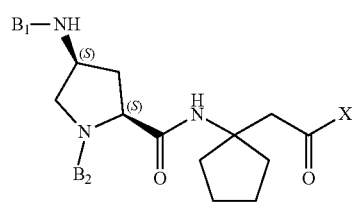
FFL-58
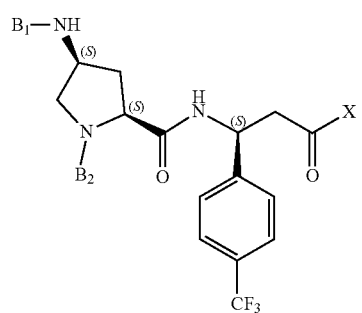
FFL-59
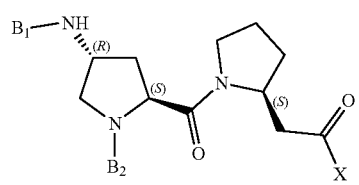
FFL-60
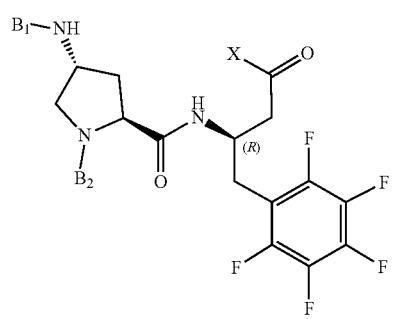
FFL-61
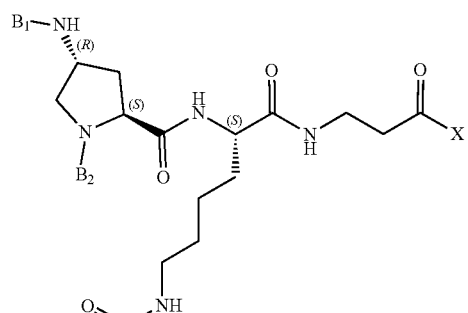
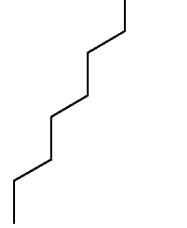
FFL-62
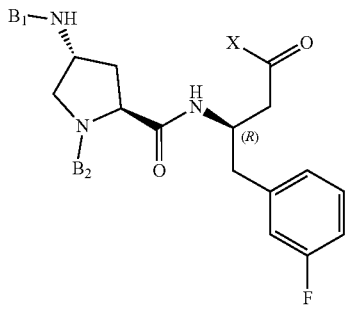
FFL-63
FFL-64
FFL-65
FFL-66
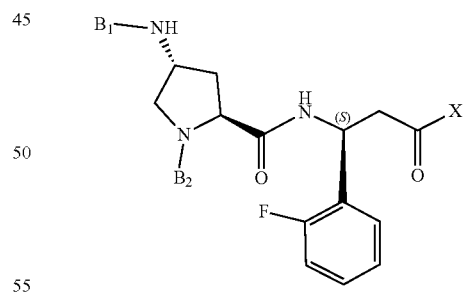

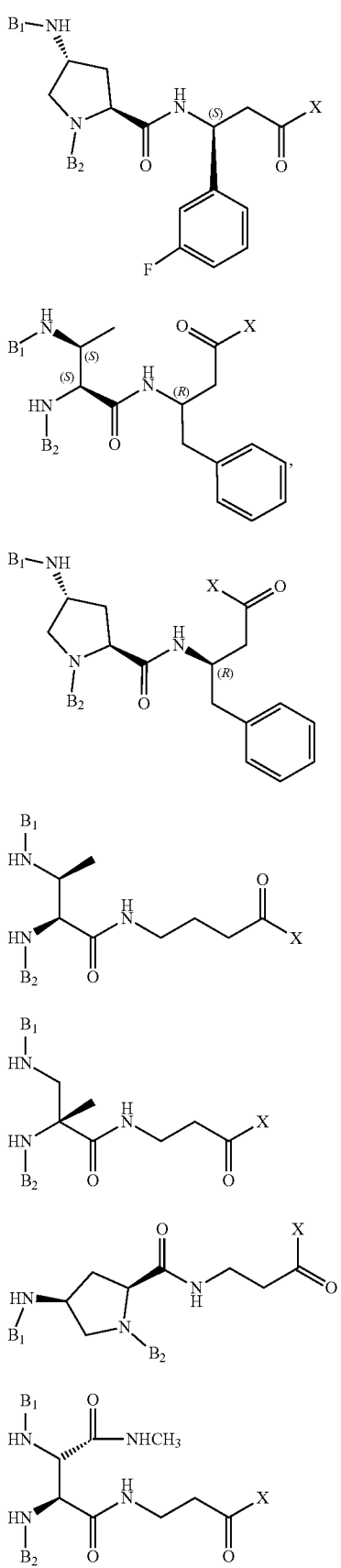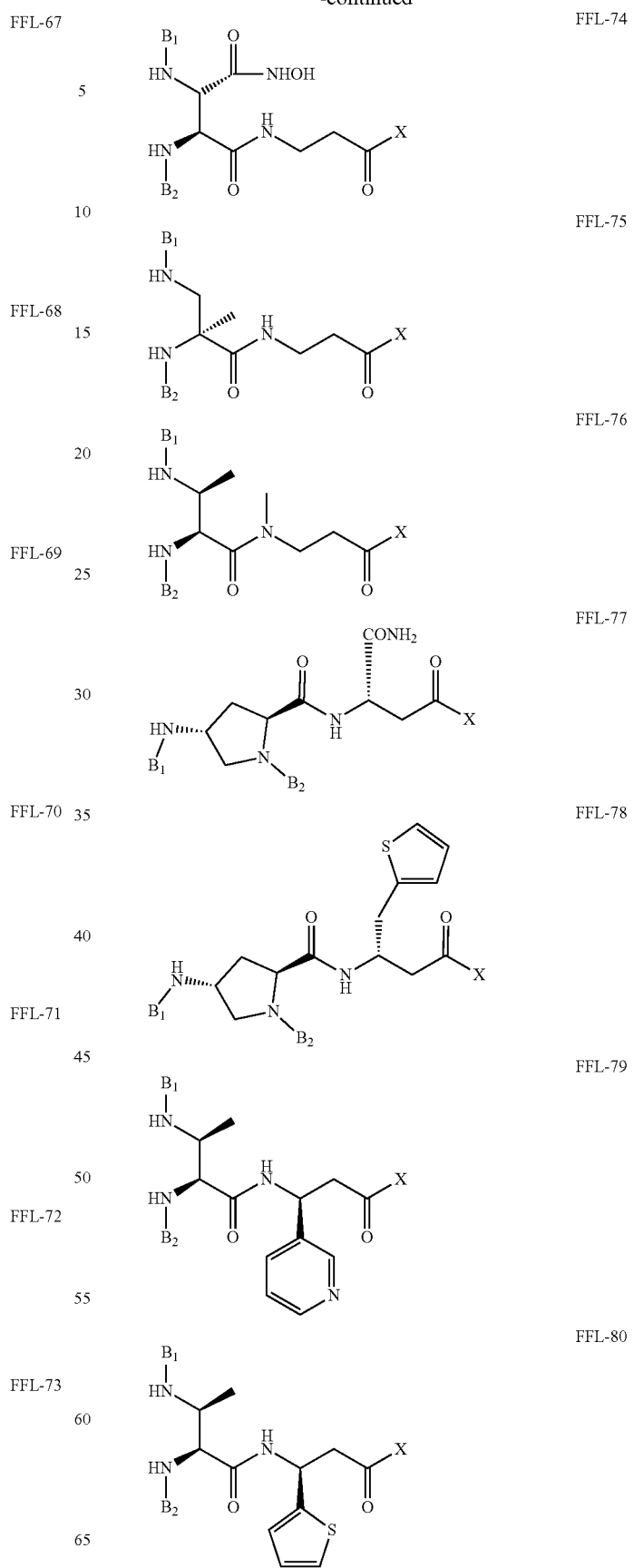

FFL-81
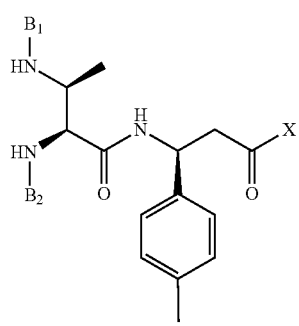
FFL-82
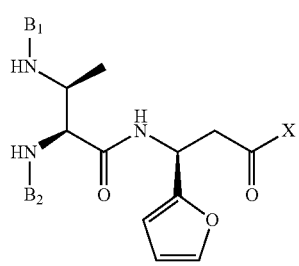
FFL-83
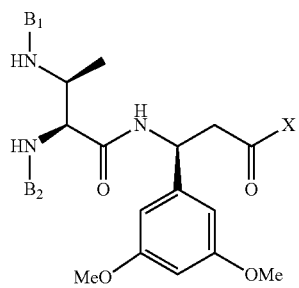
FFL-84
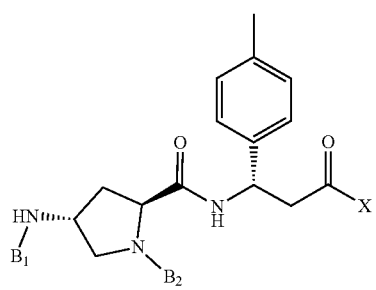
FFL-85
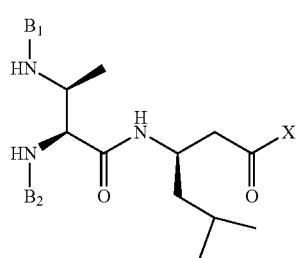
FFL-86
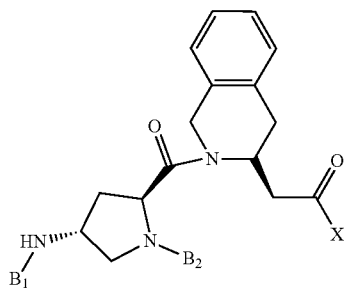
FFL-87
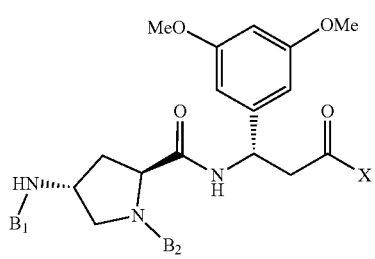
FFL-88
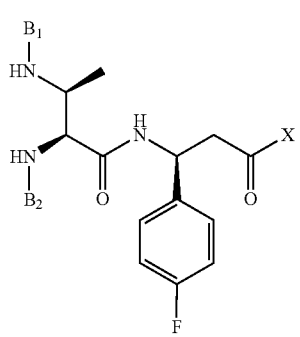
FFL-89
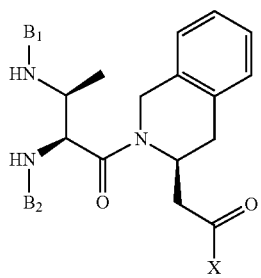
FFL-90
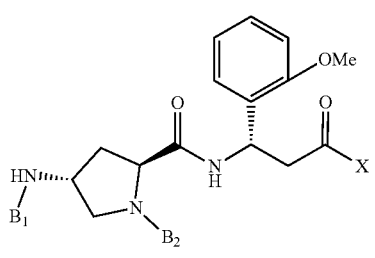

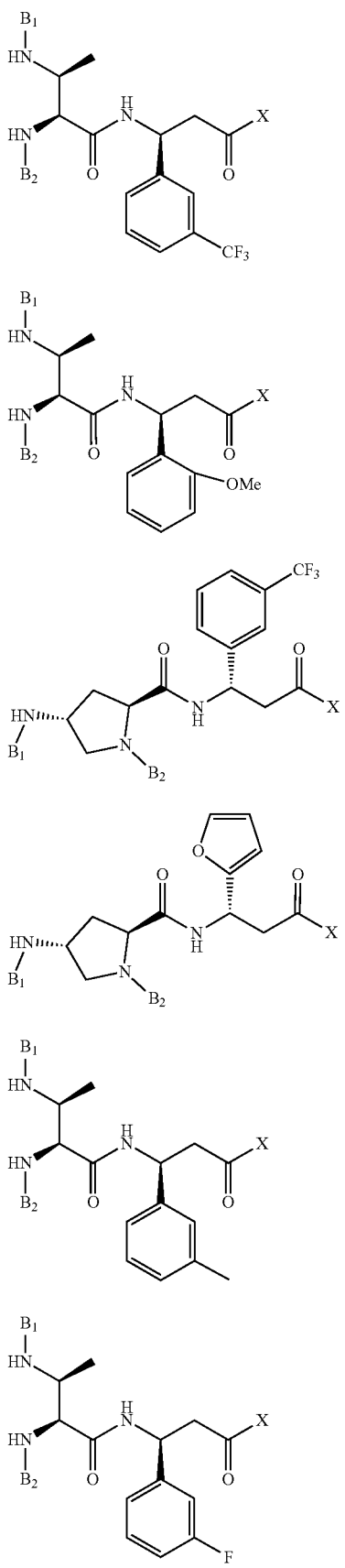

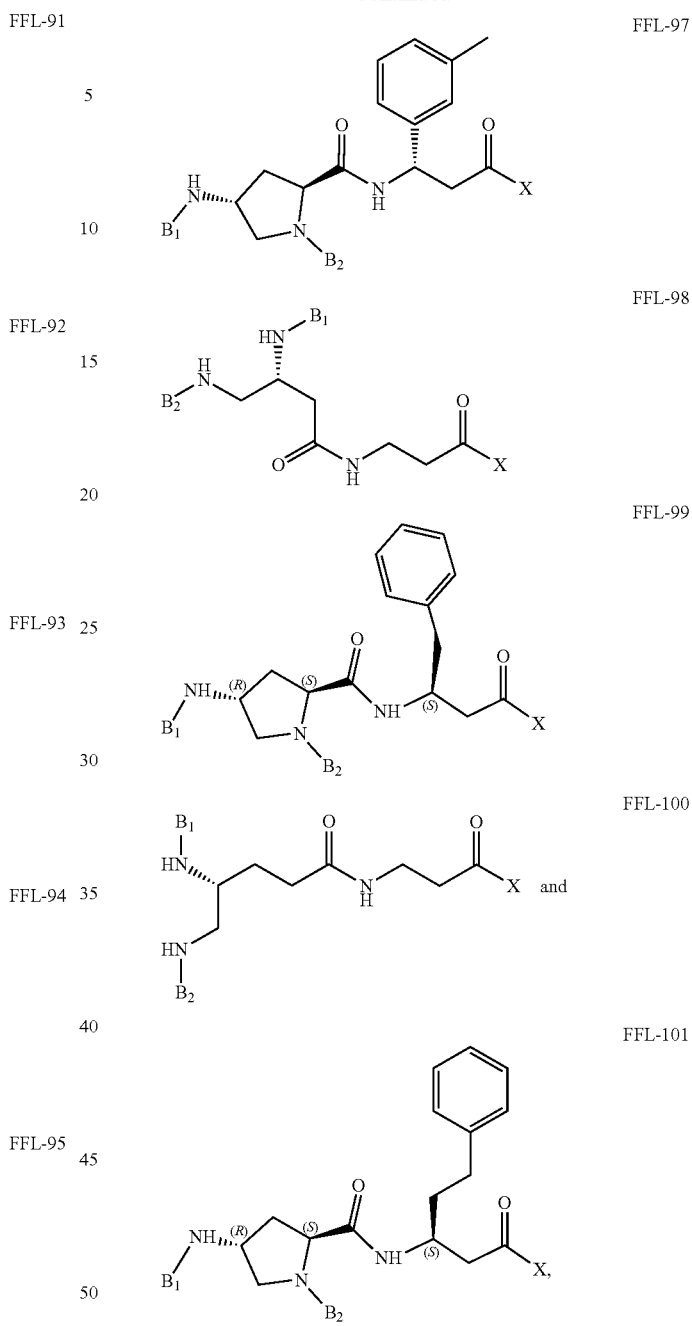

and stereoisomers thereof;

wherein X represents a point of covalent attachment either directly to an amine of X1 or to $NH_2$ when X1 is $NH_2$ or to OH when X1 is OH or to an amine that is covalently conjugated directly or indirectly to X1 or to an amine of Zia.

In some embodiments, B1 and the B2 are selected from Formula F2 wherein each remaining $R_1$ is independently selected from H, $CF_3$ and F; wherein each Z1c is covalently conjugated to an indirect linker and each of the Z1c and the indirect linker in combination is selected from Formulae FFL-1-4, 6-7, 9, 13-16, 20-23, 28-29, 31-33, 39, 42-45, 48, 53, 57-58, 60-62, 65, and 67:

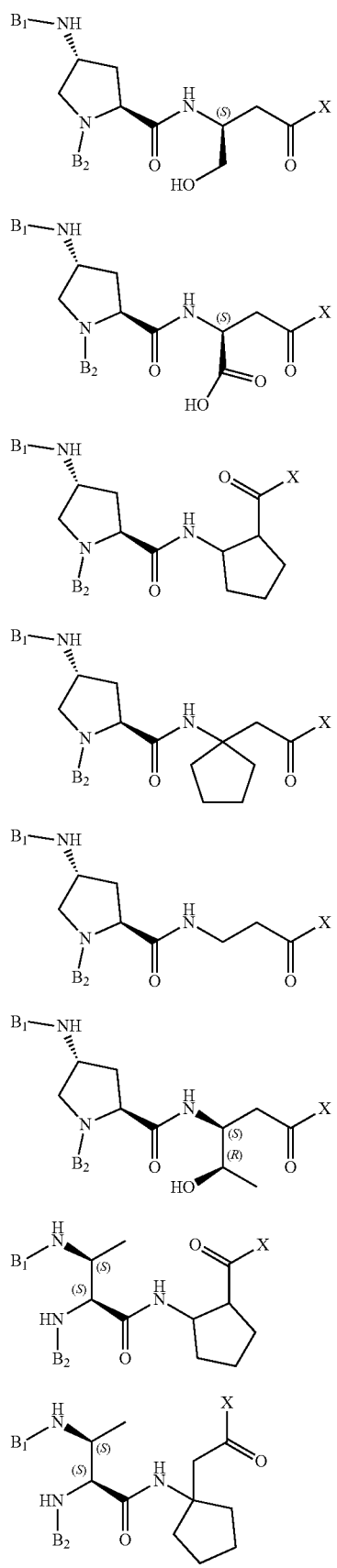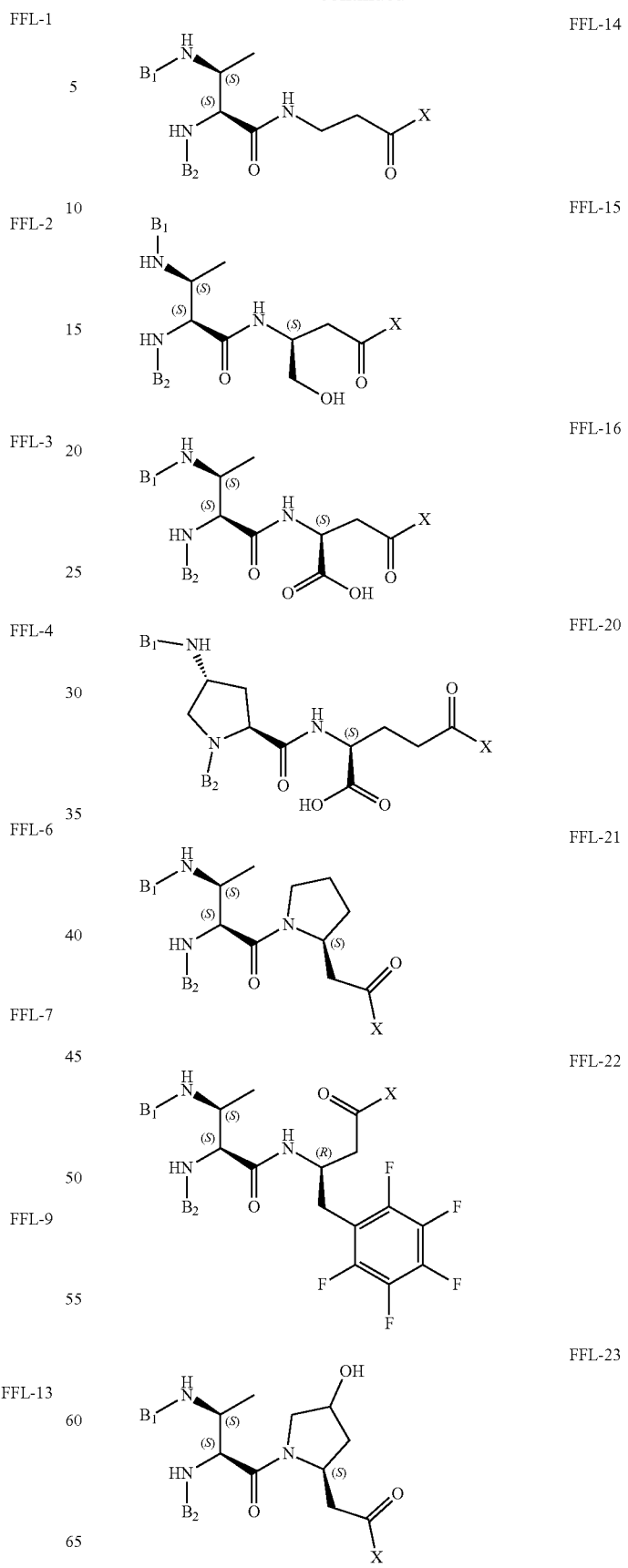

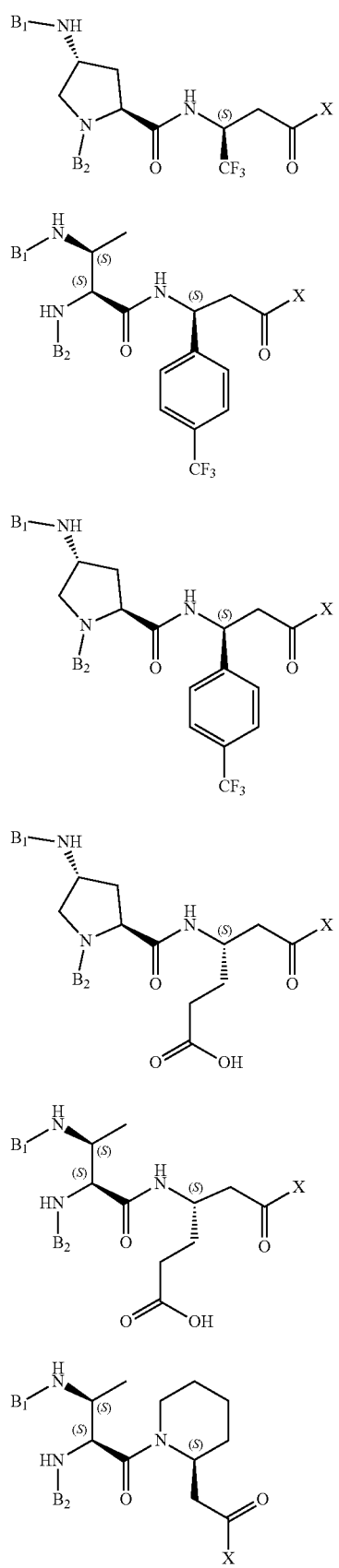
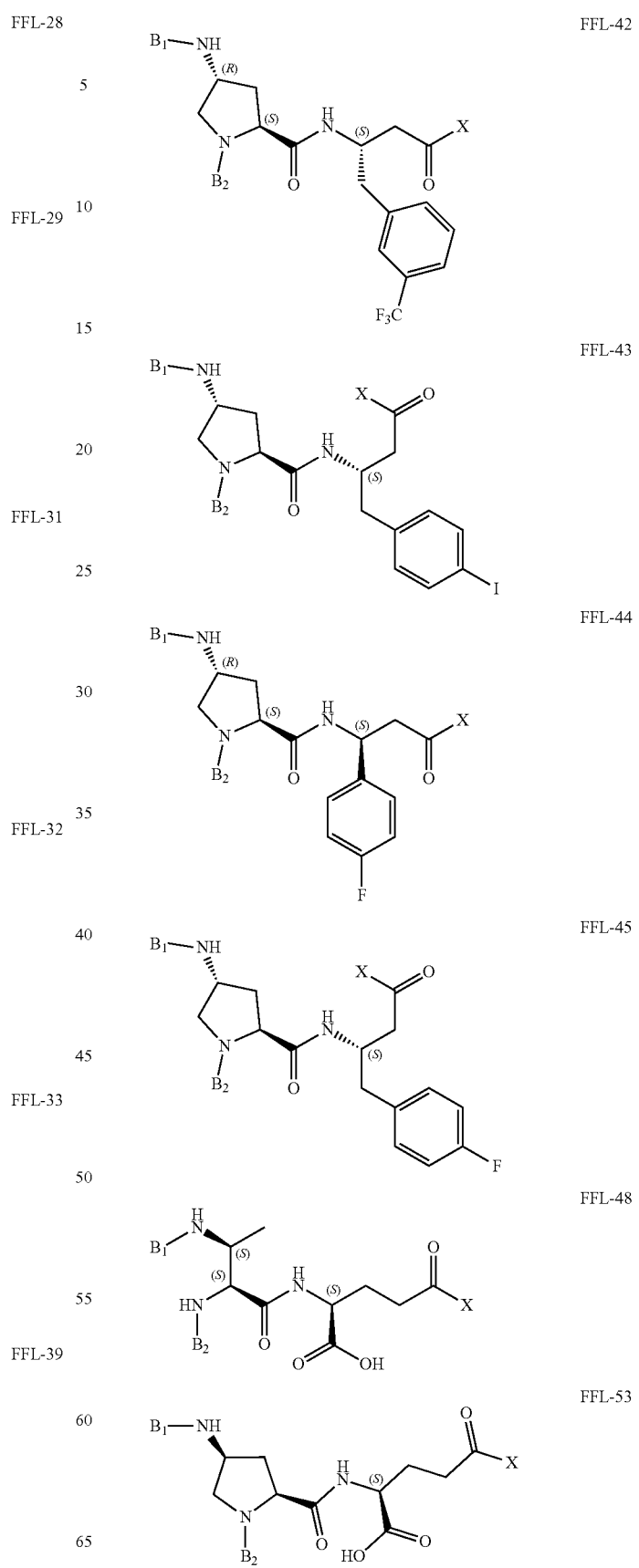

91
-continued

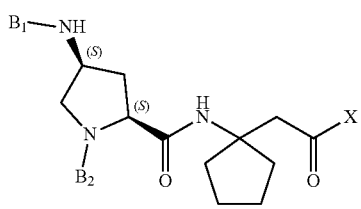
FFL-57

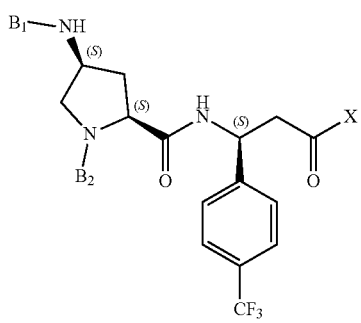
FFL-58

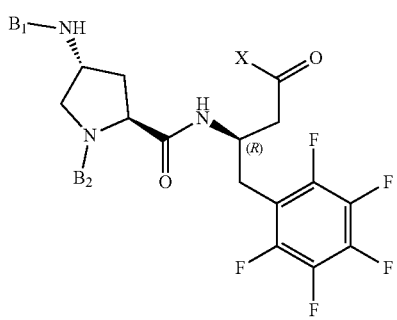
FFL-60

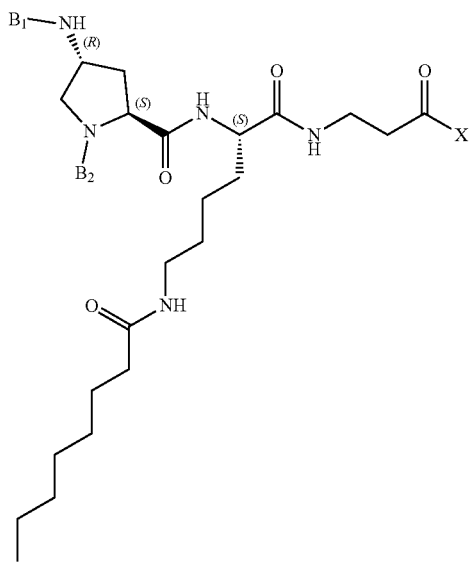
FFL-61

92
-continued

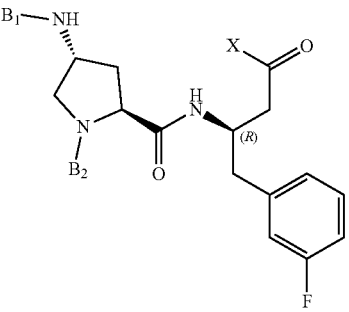
FFL-62

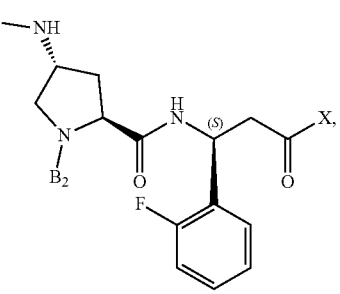
FFL-65

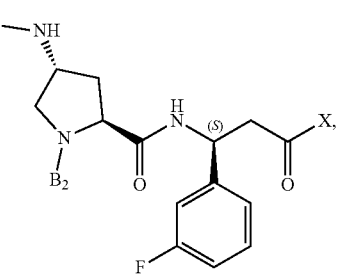
FFL-67 and stereoisomers thereof;
wherein X represents a point of covalent attachment either directly to an amine of X1 or to NH$_2$ when X1 is NH$_2$ or to OH when X1 is OH or to an amine that is covalently conjugated directly or indirectly to X1 or to an amine of Z1a.

In some embodiments, X1 is a polypeptide drug substance comprising one or more lysine amino acids each independently conjugated, directly or via an indirect linker, to a Z1c.

In some embodiments, X1 comprises a polypeptide human hormone, an endocrine hormone, insulin, human insulin, glucagon, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, or an analogue of any thereof.

In some embodiments, X1 comprises an insulin having an A-chain and a B-chain, wherein the A-chain comprises a sequence selected from SEQ ID NOs 1, 25, 24051, and 24052, and the B-chain comprises a sequence selected from SEQ ID NOs 24060, 24061, 24062, 24063, 24064, and 25000-25397.

In some embodiments, X1 comprises an insulin having an A-chain and a B-chain, wherein:
the A-chain comprises a sequence selected from SEQ ID NOs 24051 and 24052,
the B-chain comprises a sequence selected from SEQ ID NOs 25095, 25229, 25232, 25236, 25305, 25308, 25312, and 25380-25397;

each Z1c is independently selected from FF12A, FF12B, FF12D, FF116A, FF116B, FF116C, and FF116D, and covalently conjugated either directly or via the indirect linker to one or more lysine residues in X1;

$B_1$ and $B_2$ is each selected from F2; and the indirect linker is independently selected from FL3, FL5, FL5A, FL5B, FL20-FL75, and stereoisomers thereof.

In some embodiments, X1 is a polypeptide comprising an insulin receptor agonist having an A-chain and a B-chain, wherein:

the A-chain comprises a sequence selected from SEQ ID NOs 1, 25, and 24051, the B-chain comprises a sequence selected from SEQ ID NOs 24060, 24063, 25228, 25313, 25393, 25396, and 25397;

each Z1c is independently selected from FF12A, FF12B, FF114A, FF115A, FF116A, and FF225A, and covalently conjugated either directly or via the indirect linker to one or more lysine residues in X1;

$B_1$ and $B_2$ is each selected from F2; and the indirect linker is independently selected from FL3, FL5, FL5A, FL5B, FL21, and stereoisomers thereof.

In some embodiments, the compound is selected from:

Example 1 (SEQ ID NOS 25398 and 25399, respectively, in order of appearance):

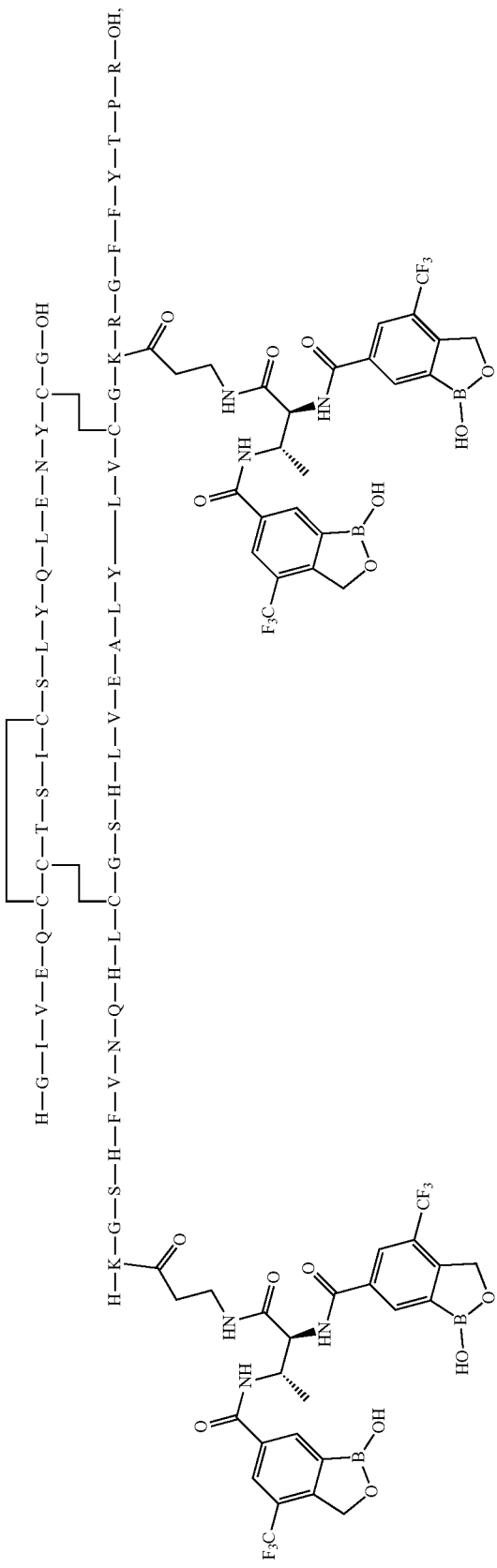

Example 2 (SEQ ID NOS 25400 and 25401, respectively, in order of appearance):

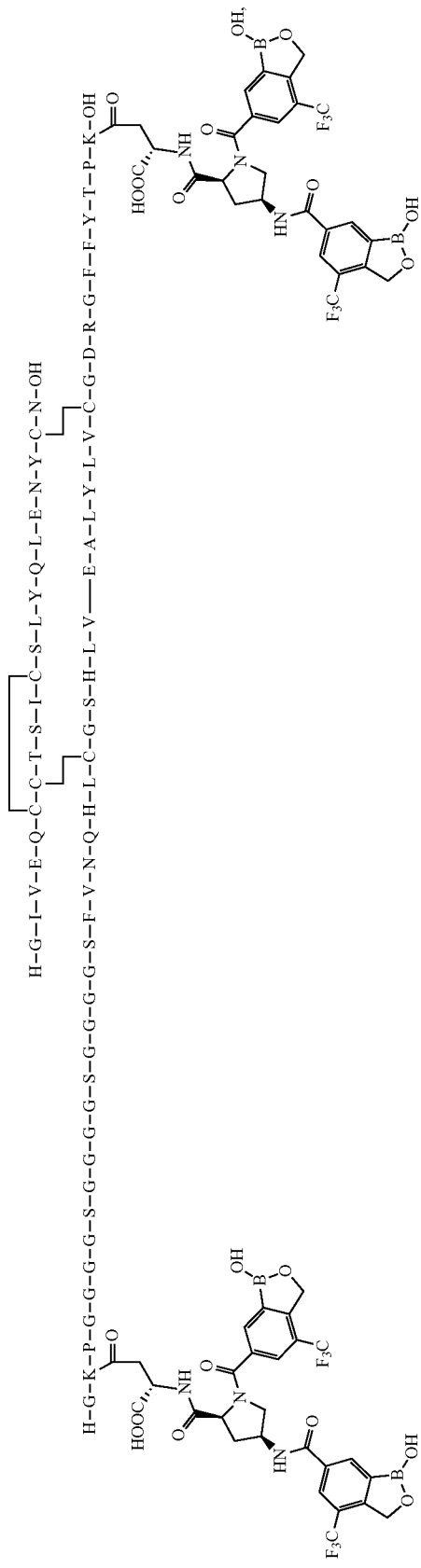

Example 3 (SEQ ID NOS 25402 and 25403, respectively, in order of appearance):
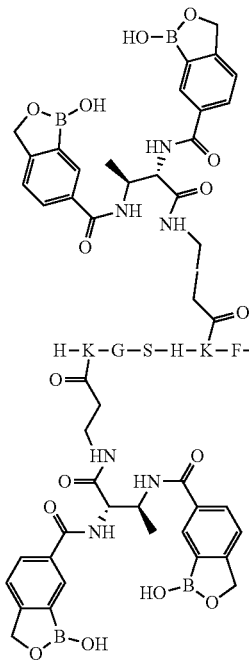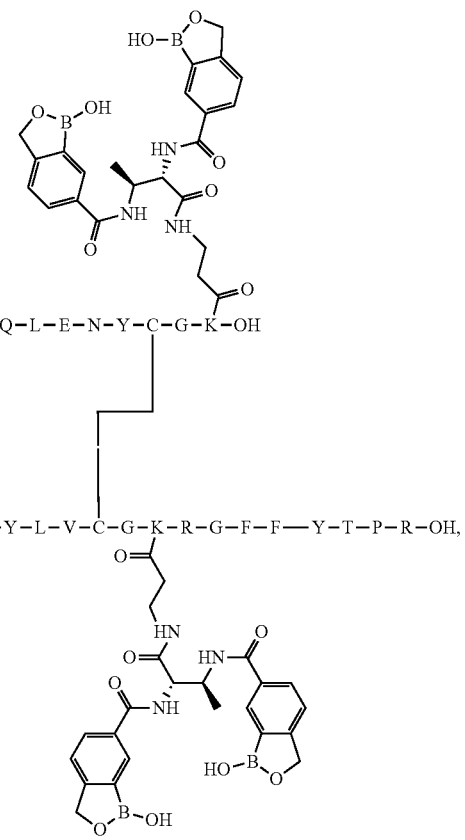
Example 4 (SEQ ID NOS 25404 and 25405, respectively, in order of appearance):

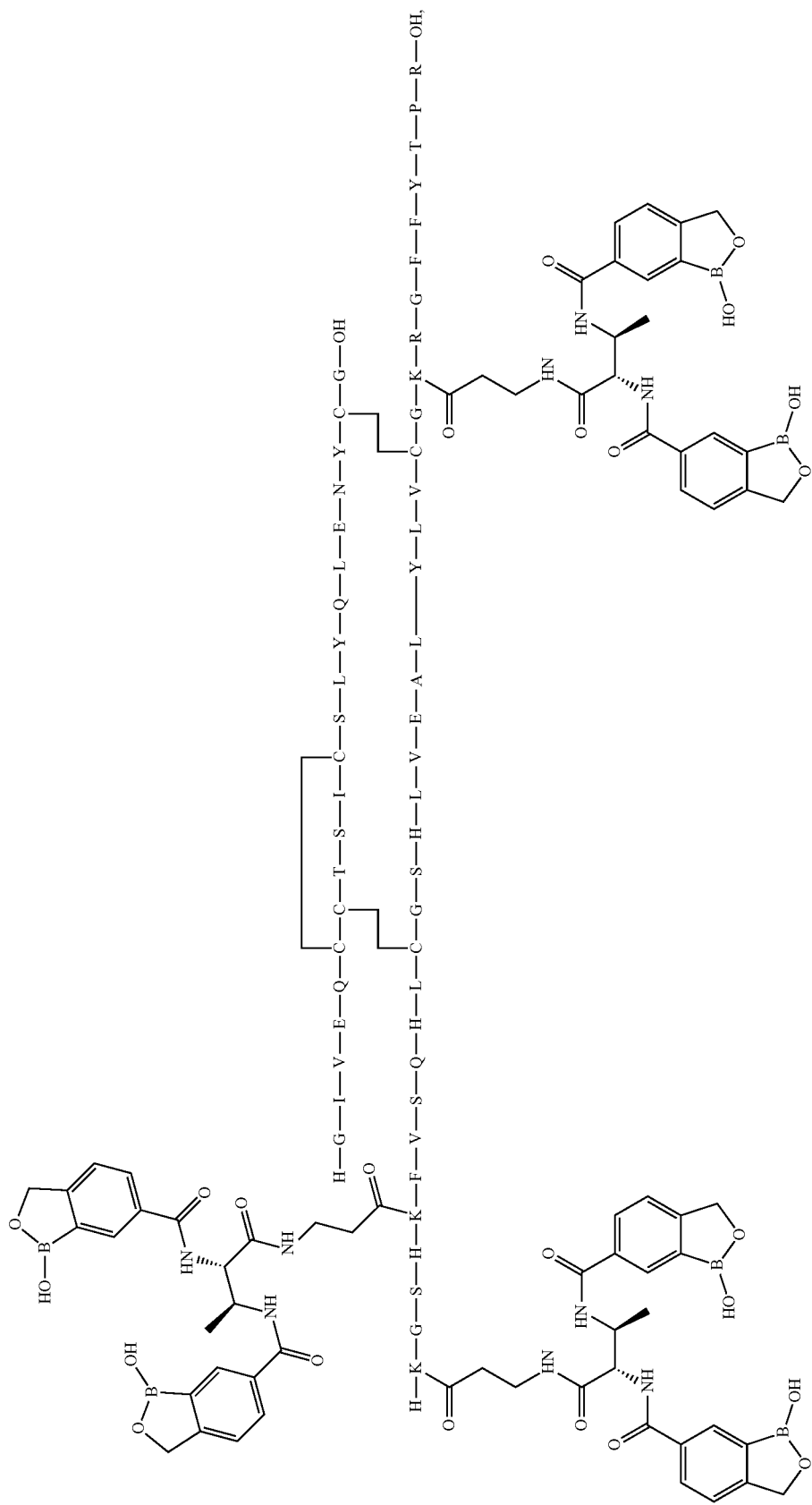

Example 5 (SEQ ID NOS 25406 and 25407, respectively, in order of appearance):

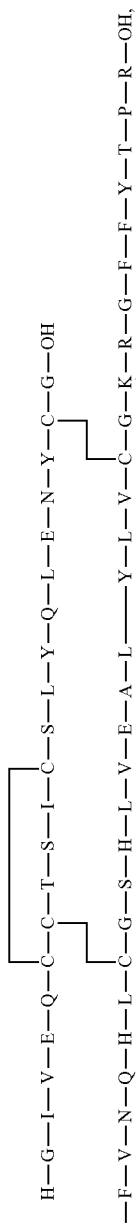
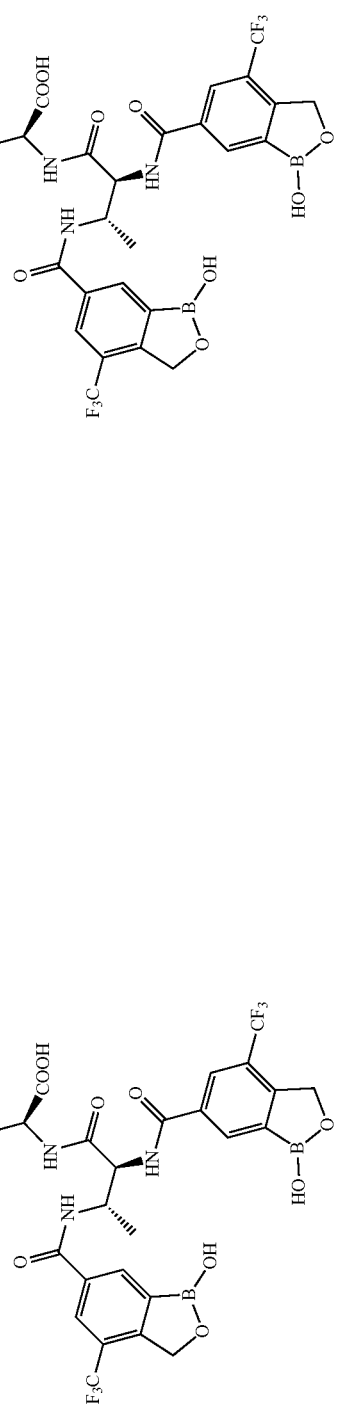

Example 6 (SEQ ID NOS 25408 and 25409, respectively, in order of appearance):

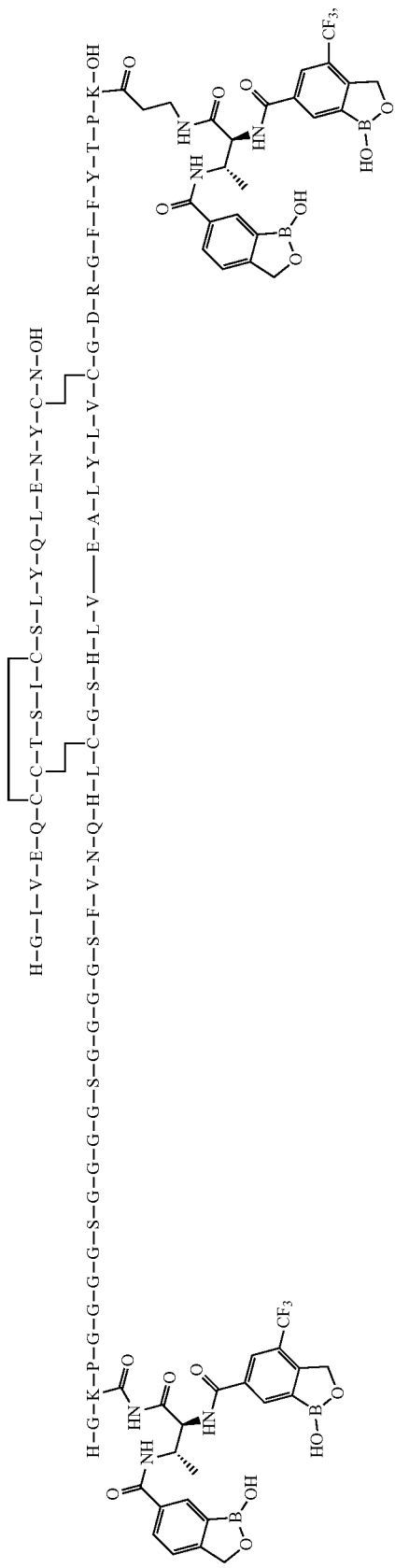

Example 7 (SEQ ID NOS 25410 and 25411, respectively, in order of appearance):
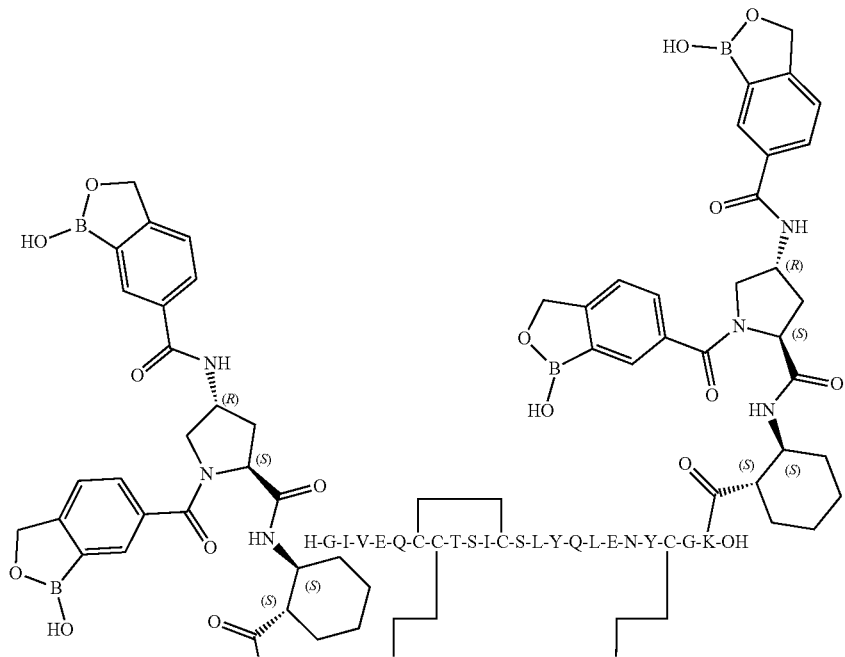
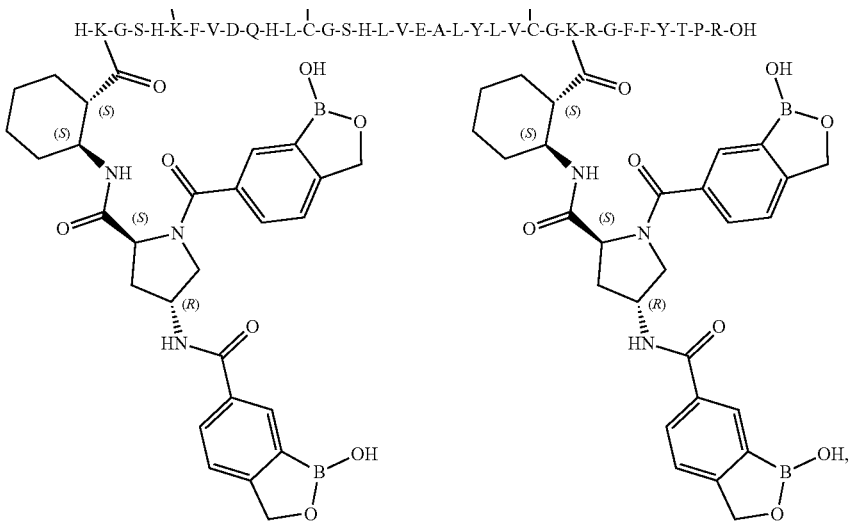

Example 8 (SEQ ID NOS 25412 and 25413, respectively, in order of appearance):
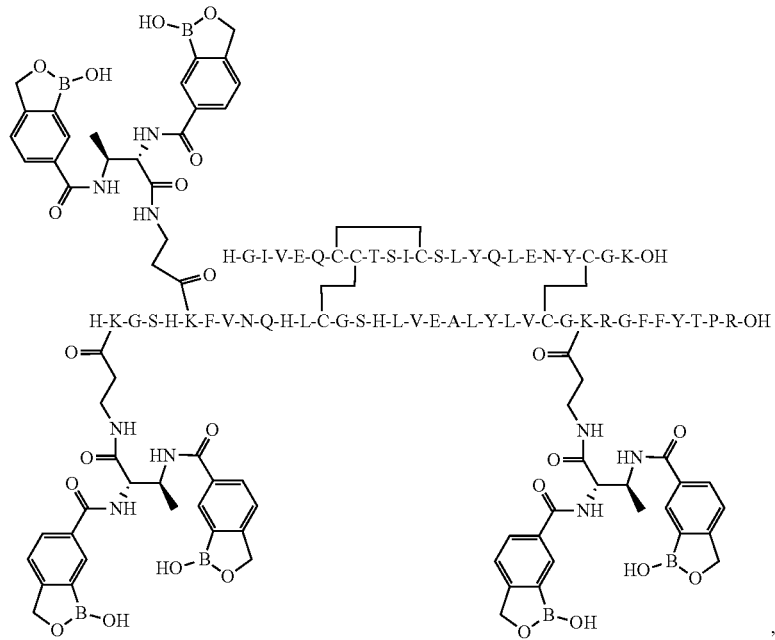
Example 9 (SEQ ID NOS 25414 and 25415, respectively, in order of appearance):
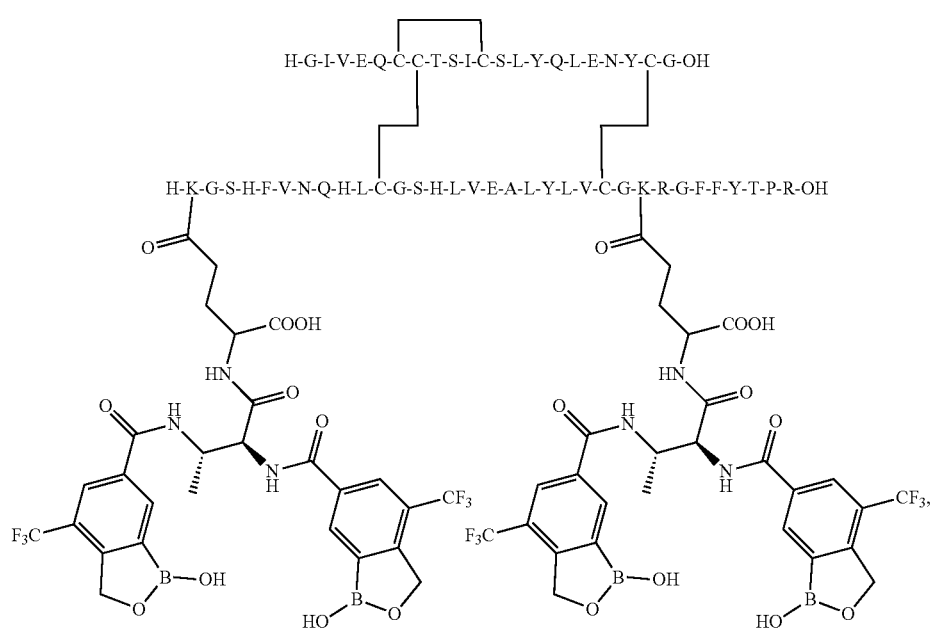
Example 10 (SEQ ID NOS 25416 and 25417, respectively, in order of appearance):

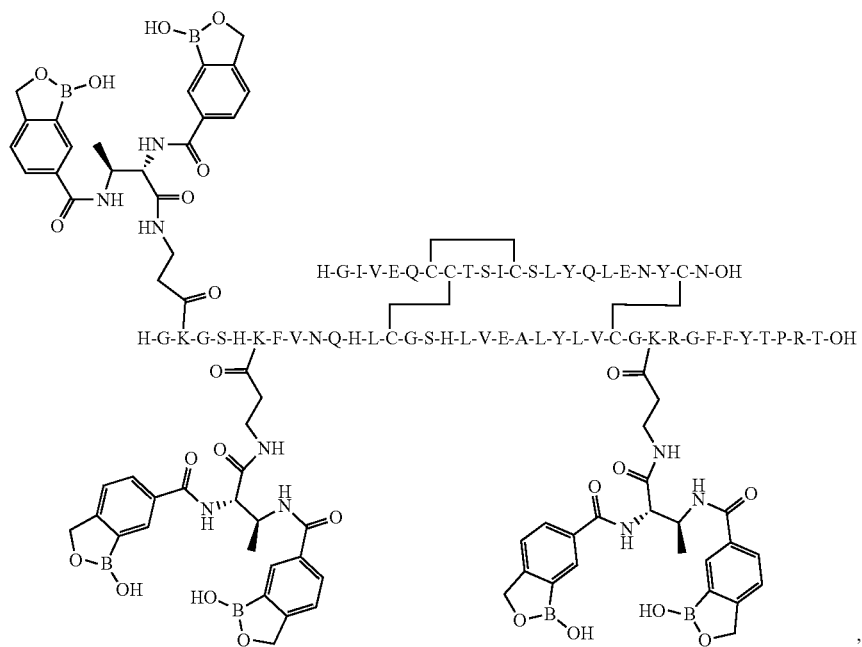
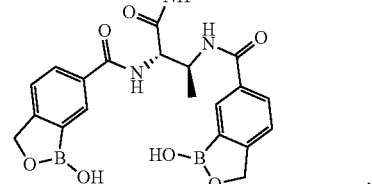
Example 11 (SEQ ID NOS 25418 and 25419, respectively, in order of appearance):
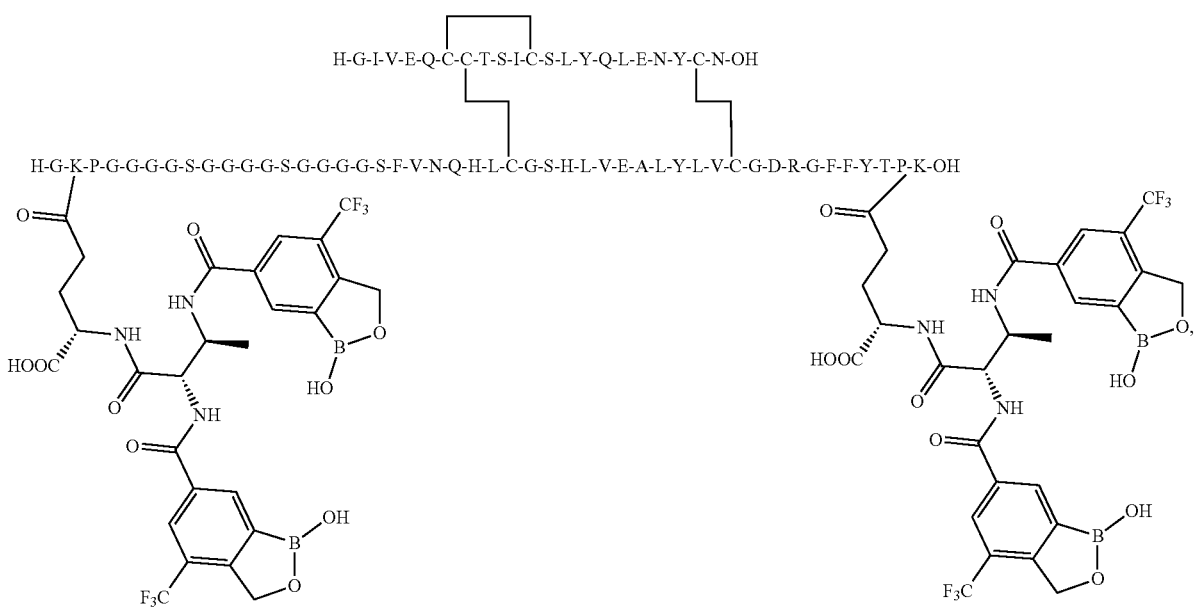
Example 12 (SEQ ID NOS 25420 and 25421, respectively, in order of appearance):

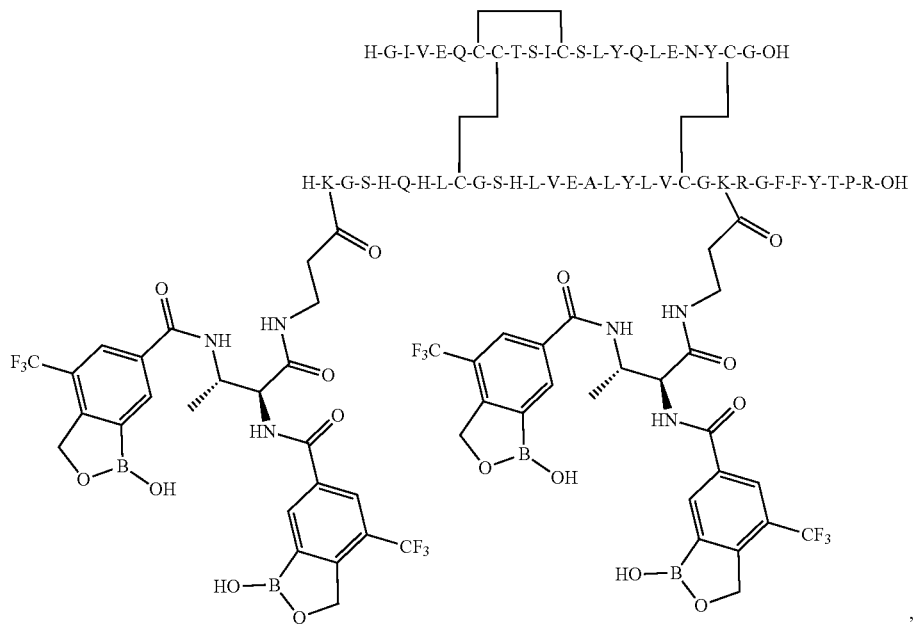
Example 13 (SEQ ID NOS 25422 and 25423, respectively, in order of appearance):
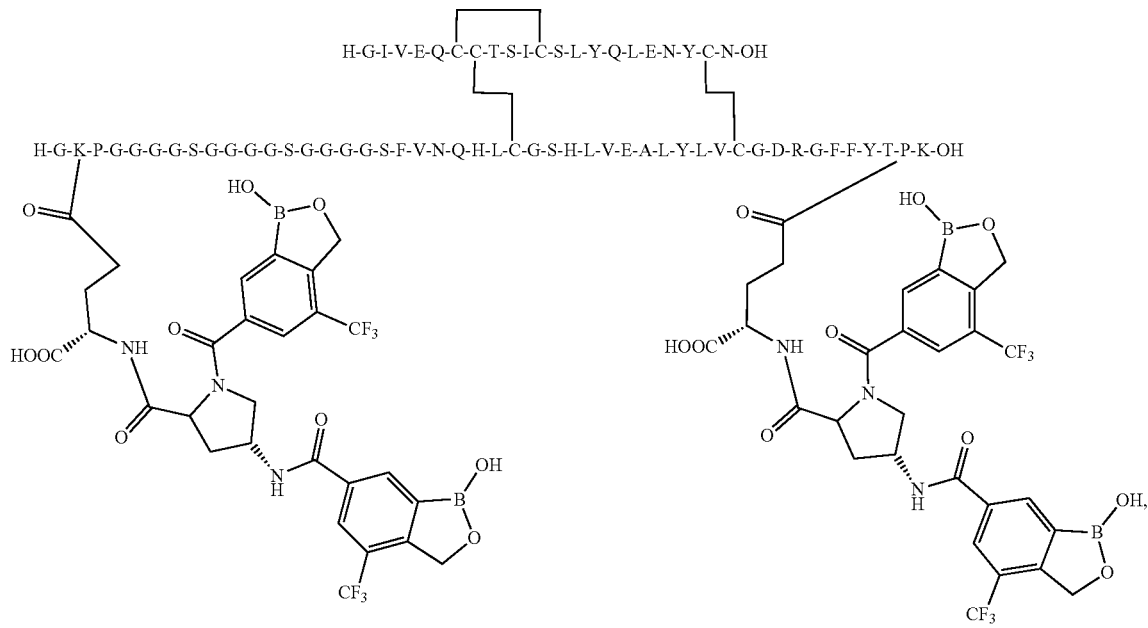
Example 14 (SEQ ID NOS 25424 and 25425, respectively, in order of appearance):

121
122
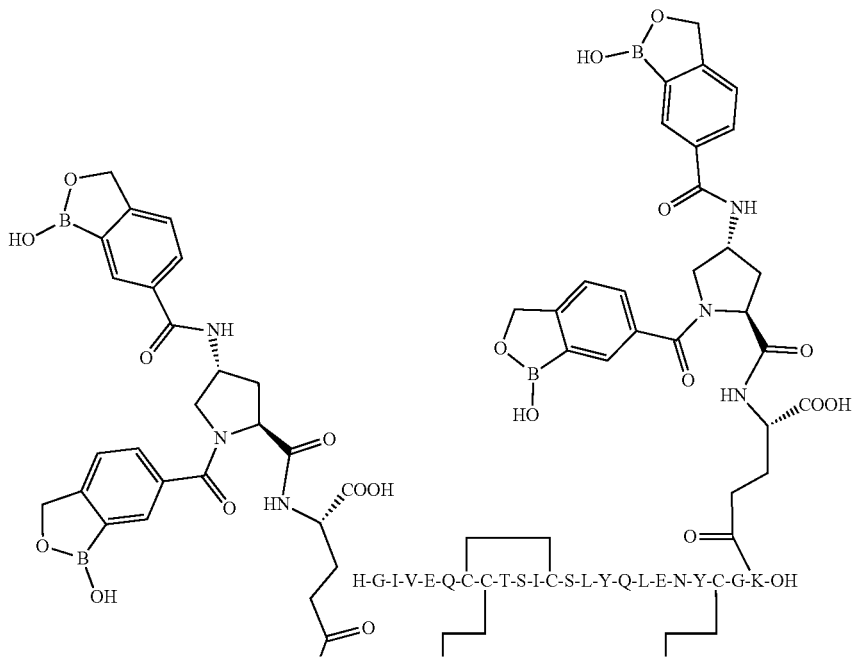
H-G-I-V-E-Q-C-C-T-S-I-C-S-L-Y-Q-L-E-N-Y-C-G-K-OH
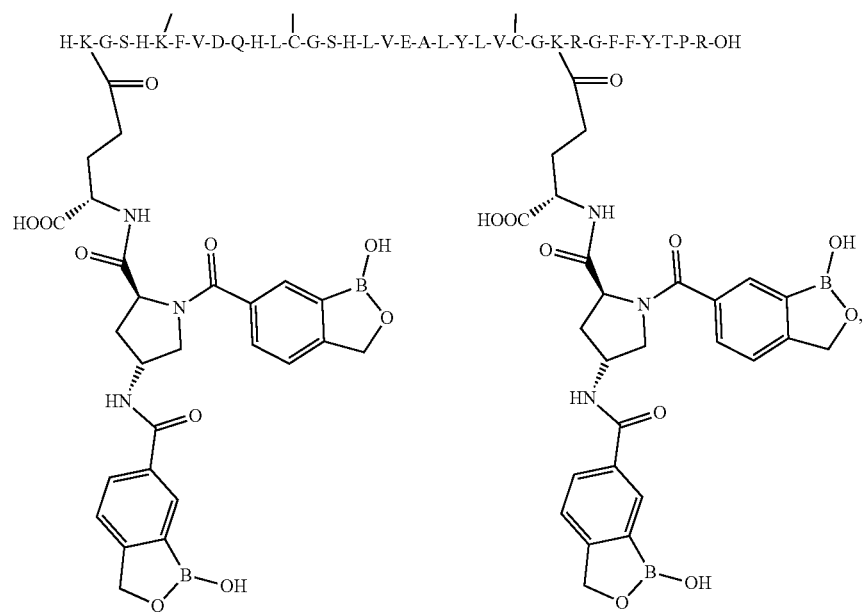
H-K-G-S-H-K-F-V-D-Q-H-L-C-G-S-H-L-V-E-A-L-Y-L-V-C-G-K-R-G-F-F-Y-T-P-R-OH
Example 15 (SEQ ID NOS 25426 and 25427, respectively, in order of appearance):

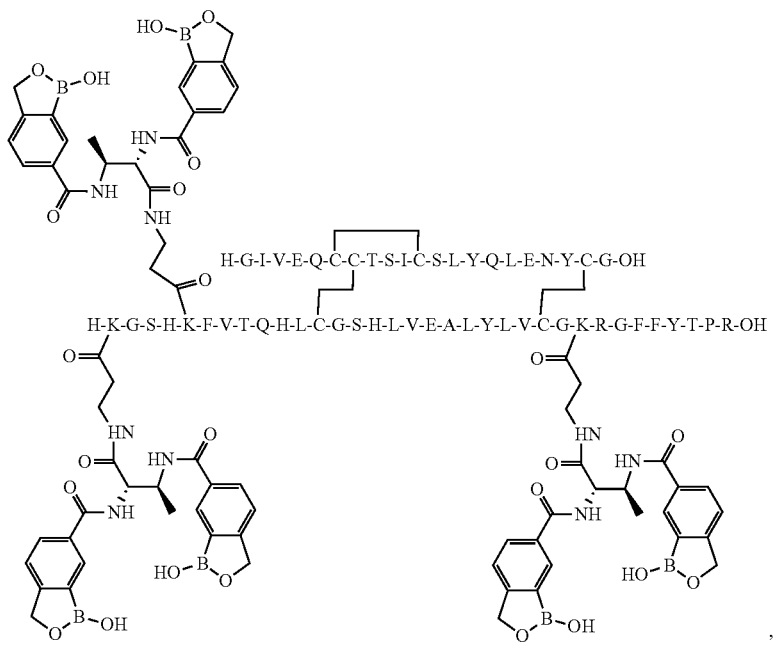
Example 16 (SEQ ID NOS 25428 and 25429, respectively, in order of appearance):
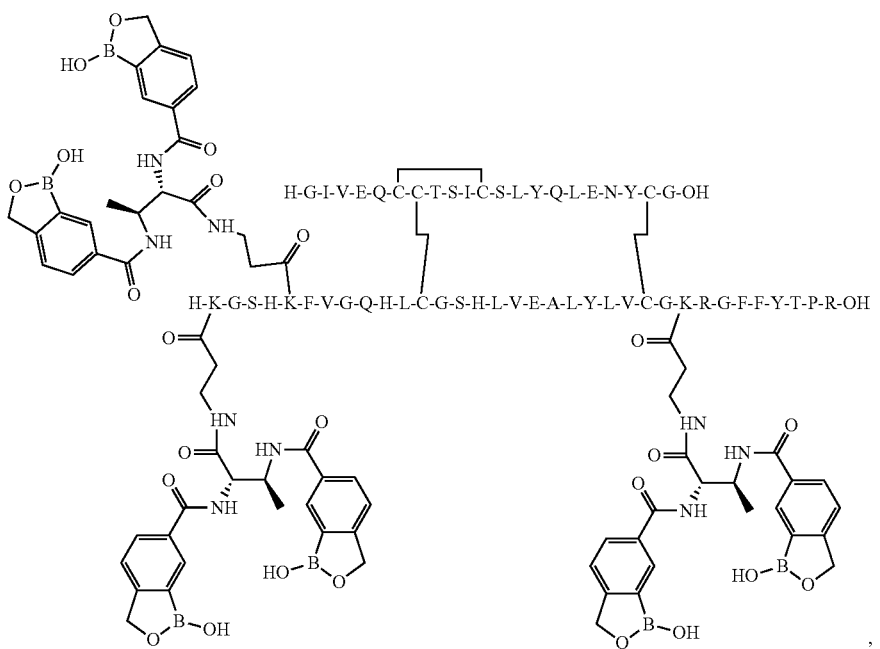
Example 17 (SEQ ID NOS 25430 and 25431, respectively, in order of appearance):

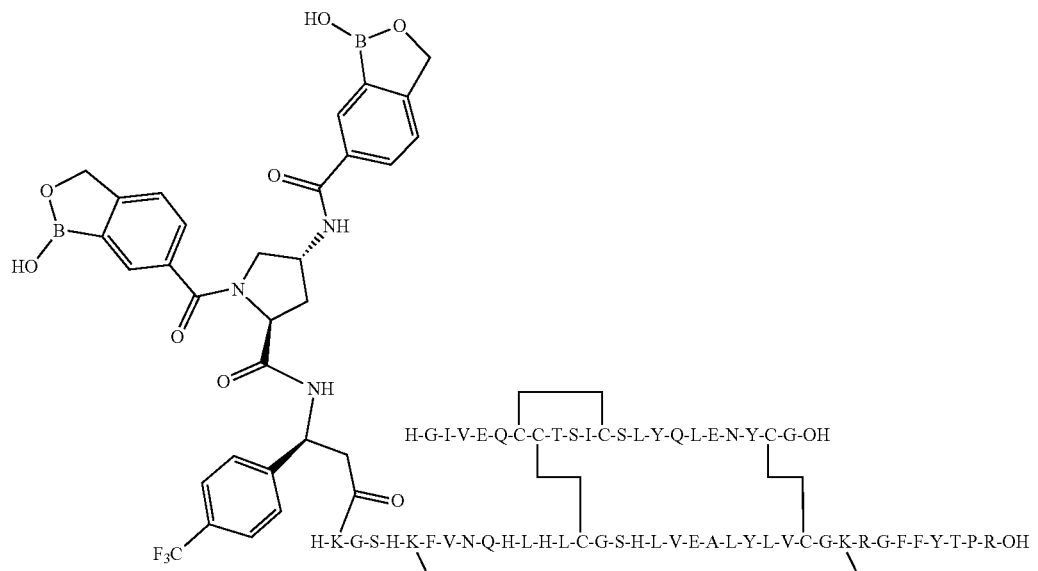
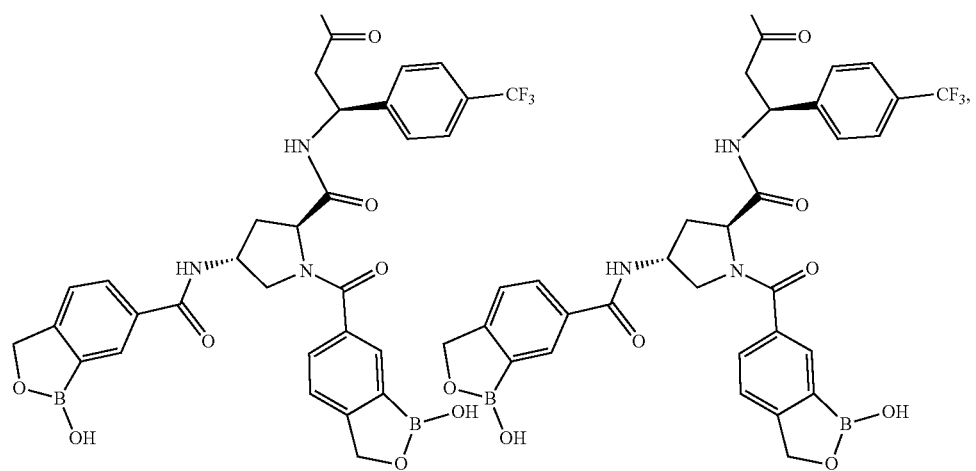
Example 18 (SEQ ID NOS 25432 and 25433, respectively, in order of appearance):

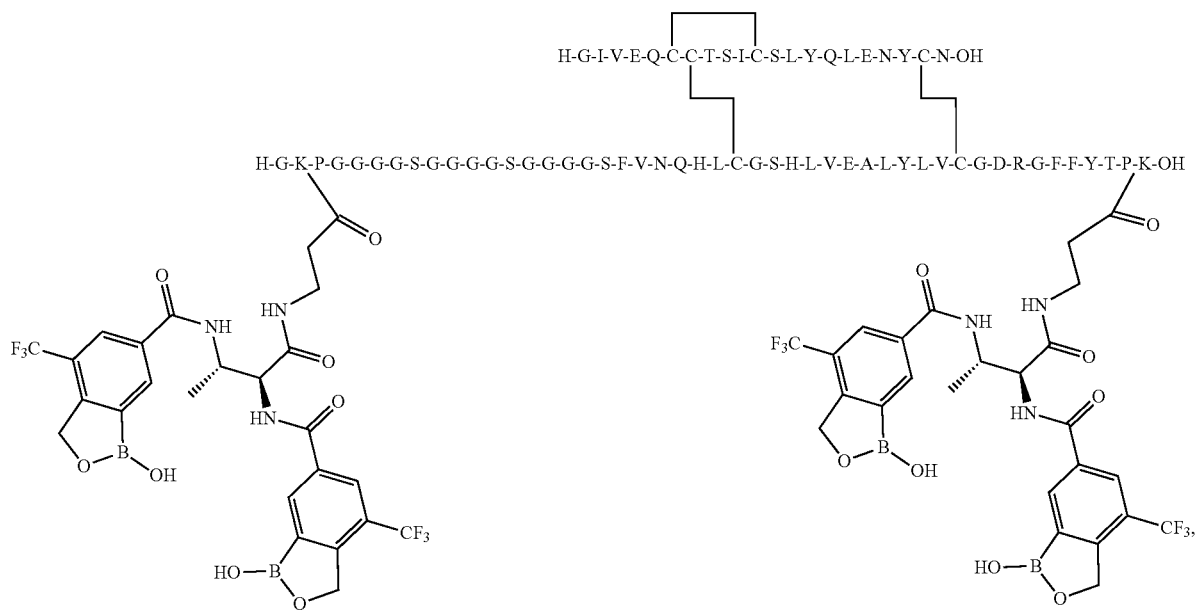
Example 19 (SEQ ID NOS 25434 and 25435, respectively, in order of appearance):
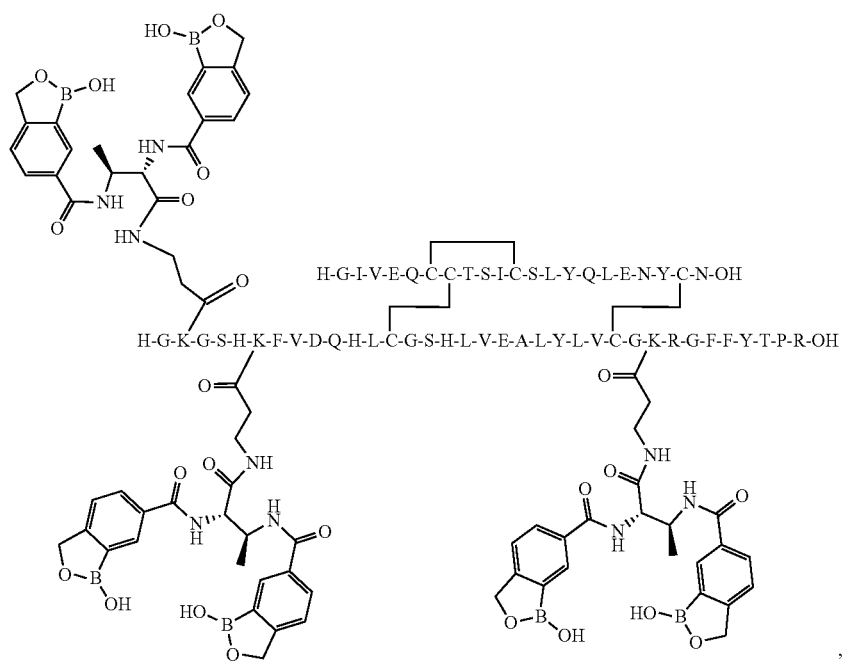
Example 20 (SEQ ID NOS 25436 and 25437, respectively, in order of appearance):

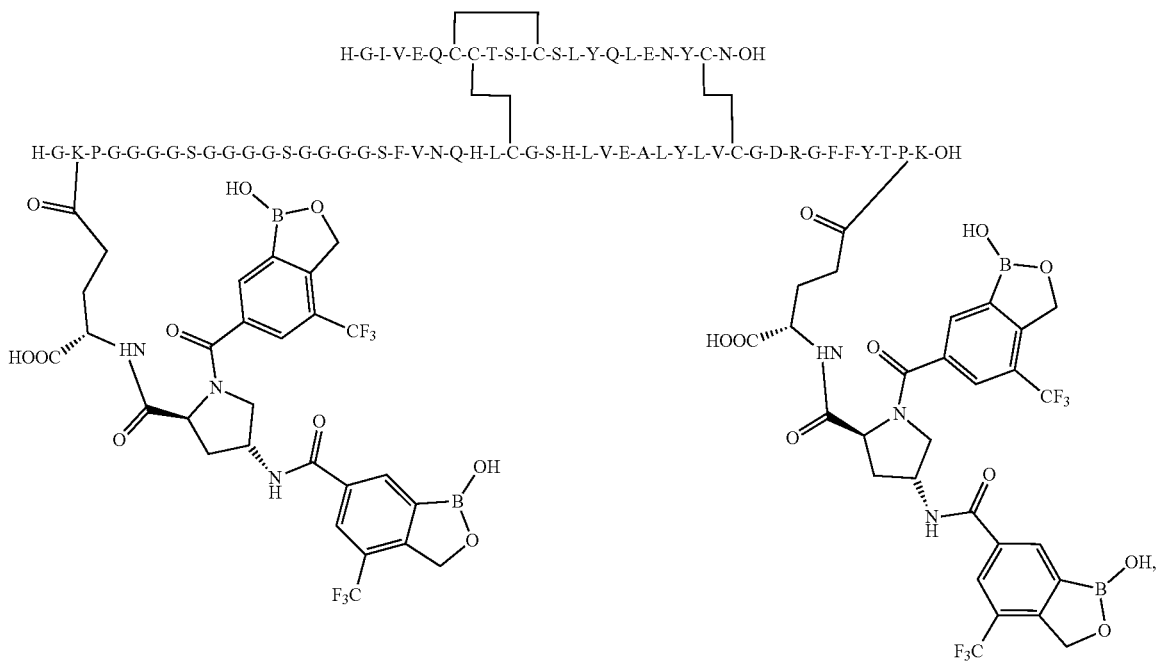
Example 21 (SEQ ID NOS 25438 and 25439, respectively, in order of appearance):
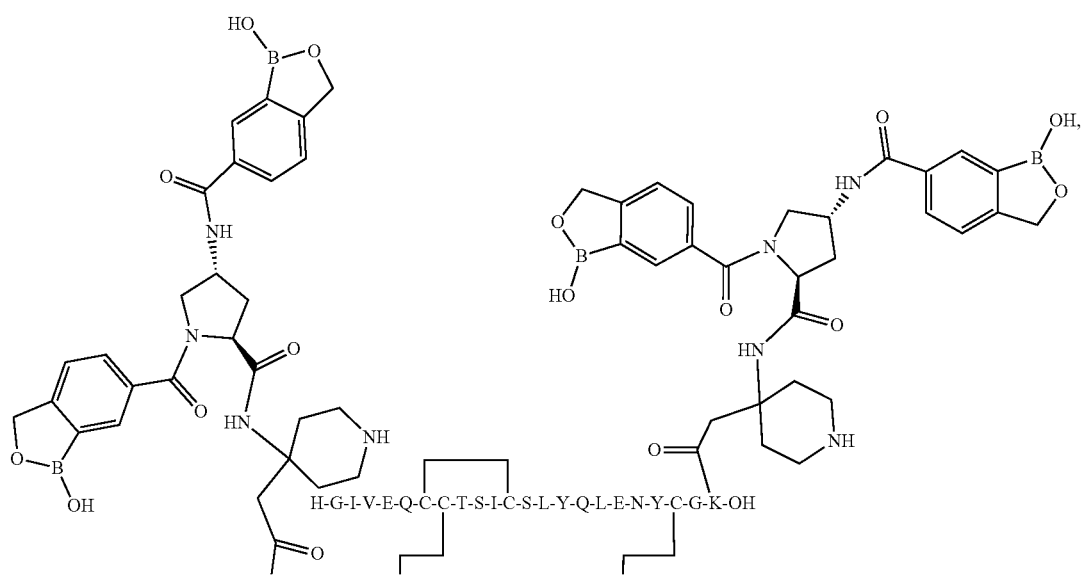

-continued
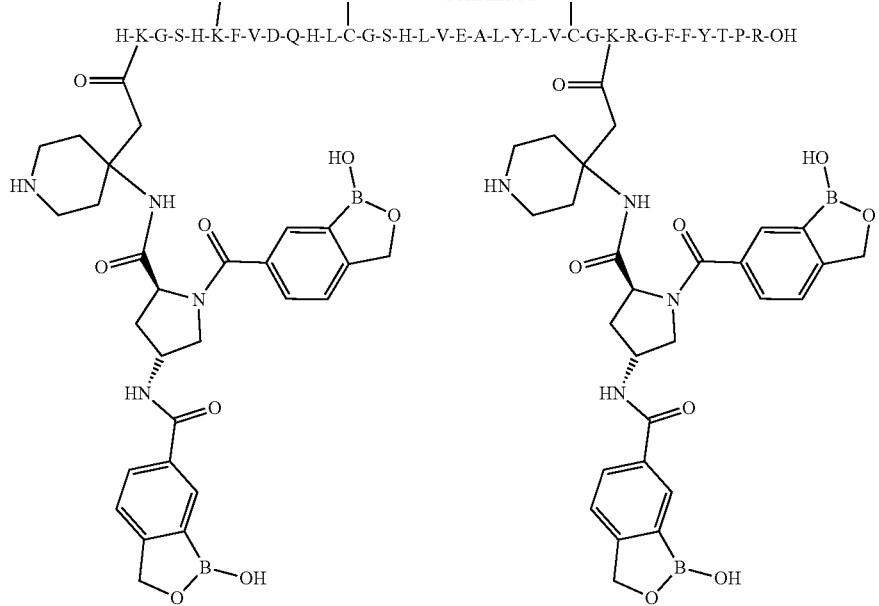
Example 22 (SEQ ID NOS 25422 and 25423, respectively, in order of appearance):
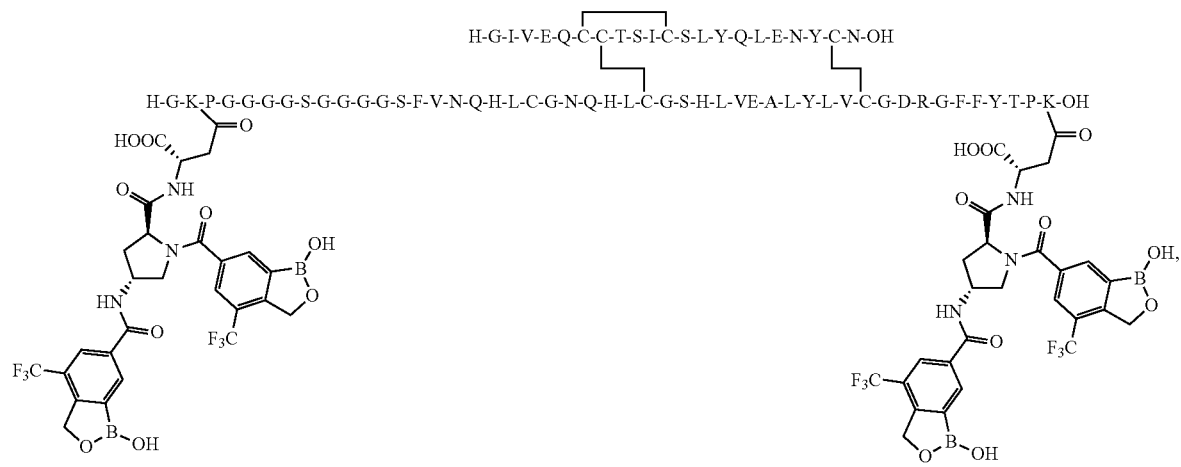
Example 23 (SEQ ID NOS 25440 and 25441, respectively, in order of appearance):

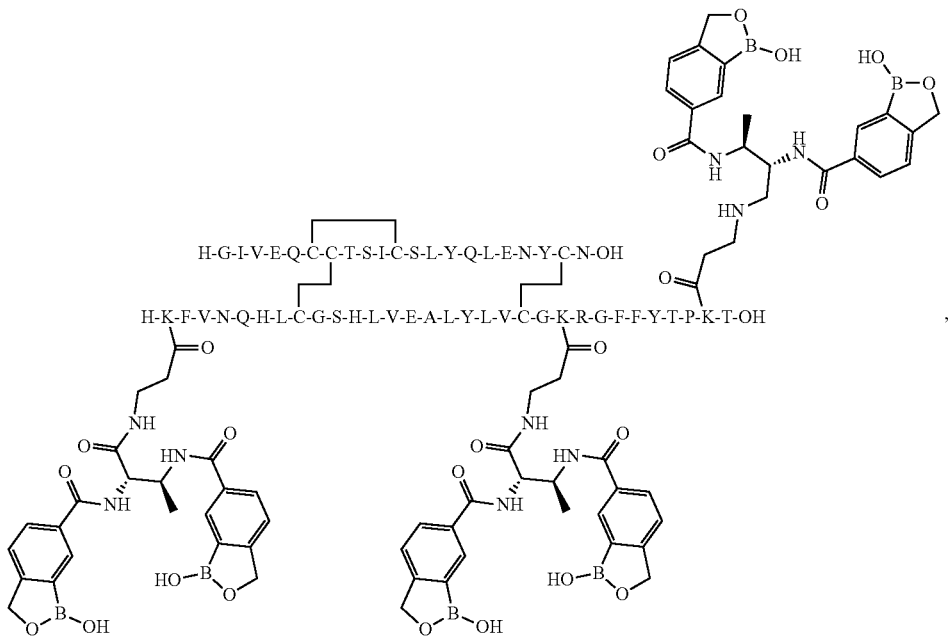
Example 24 (SEQ ID NOS 25442 and 25443, respectively, in order of appearance):
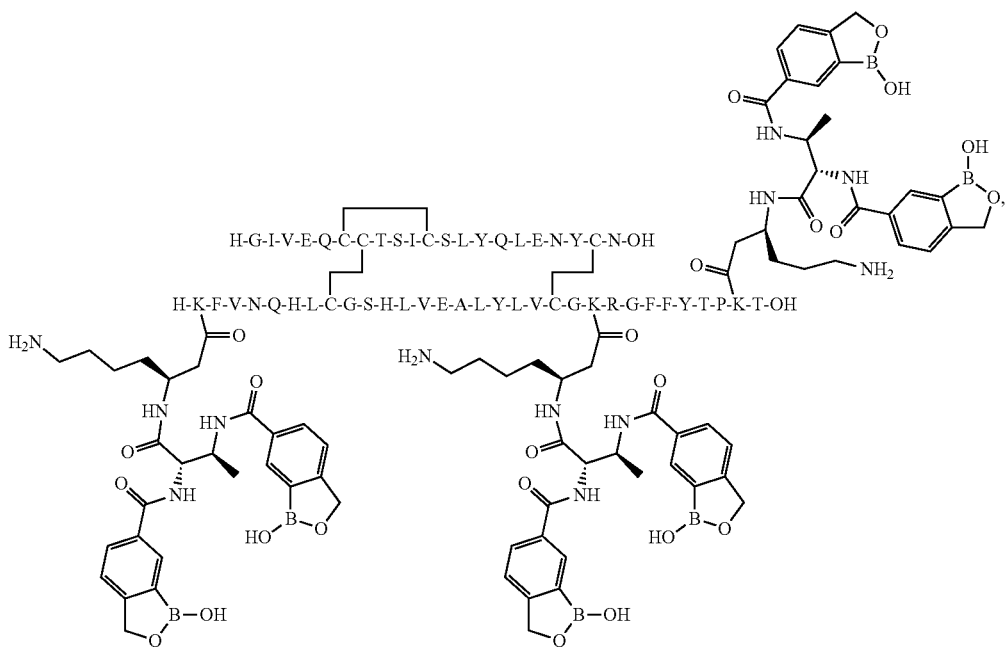
Example 25 (SEQ ID NOS 25444 and 25445, respectively, in order of appearance):

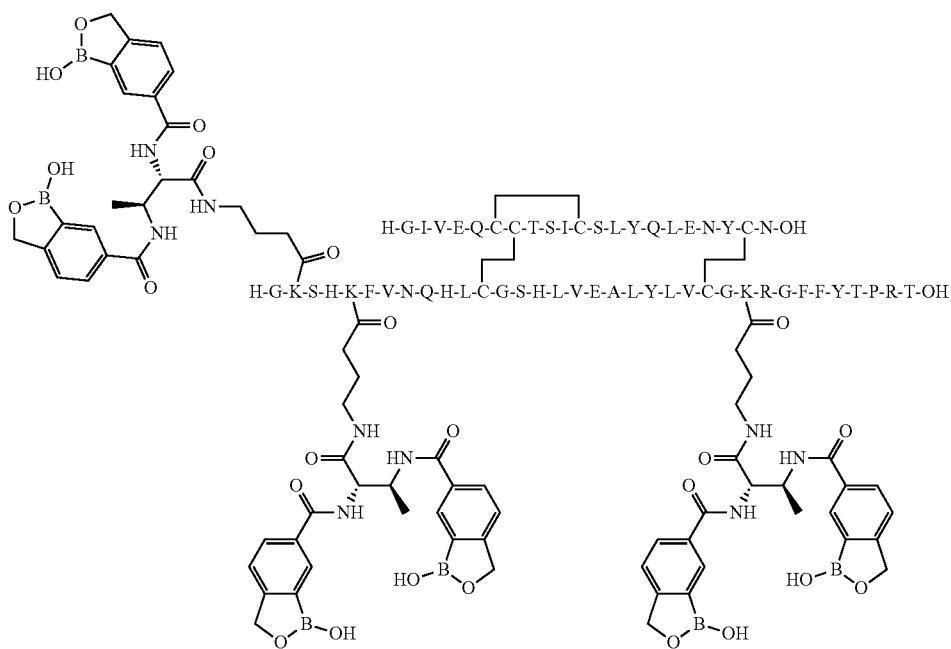
Example 26 (SEQ ID NOS 25446 and 25447, respectively, in order of appearance):
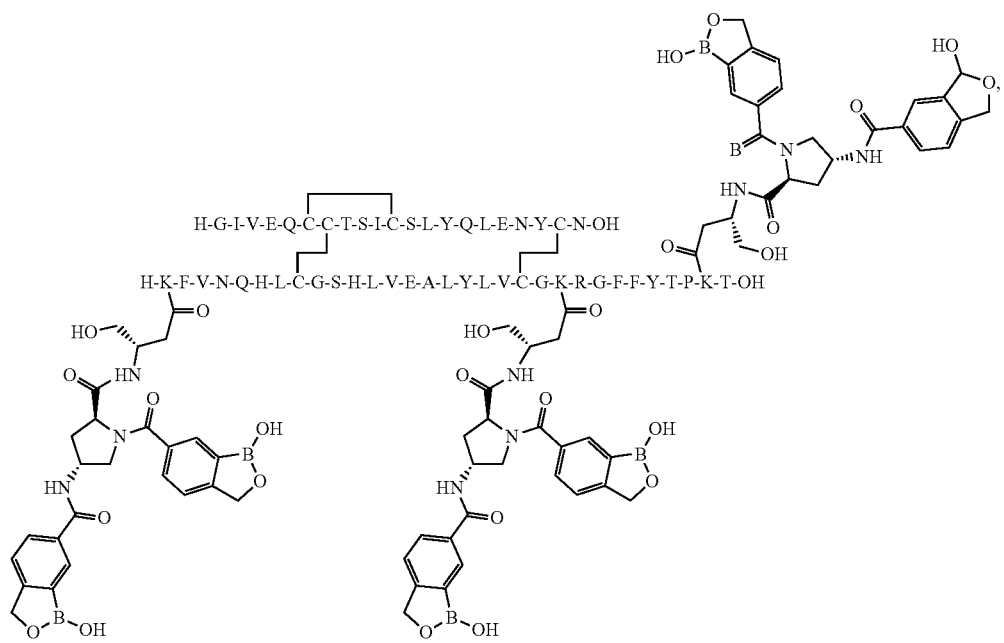
Example 27 (SEQ ID NOS 25448 and 25449, respectively, in order of appearance):

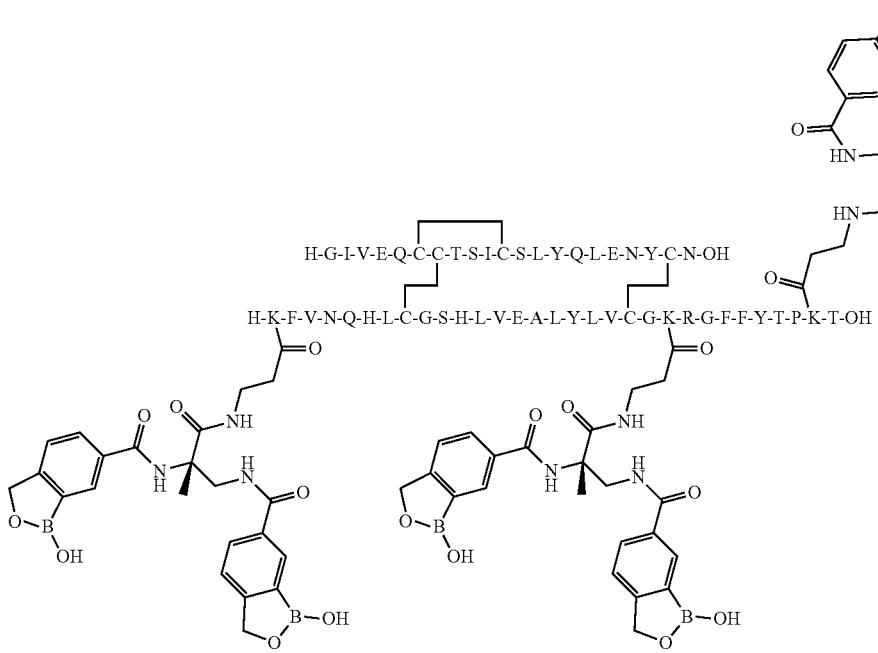
Example 28 (SEQ ID NOS 25450 and 25451, respectively, in order of appearance):
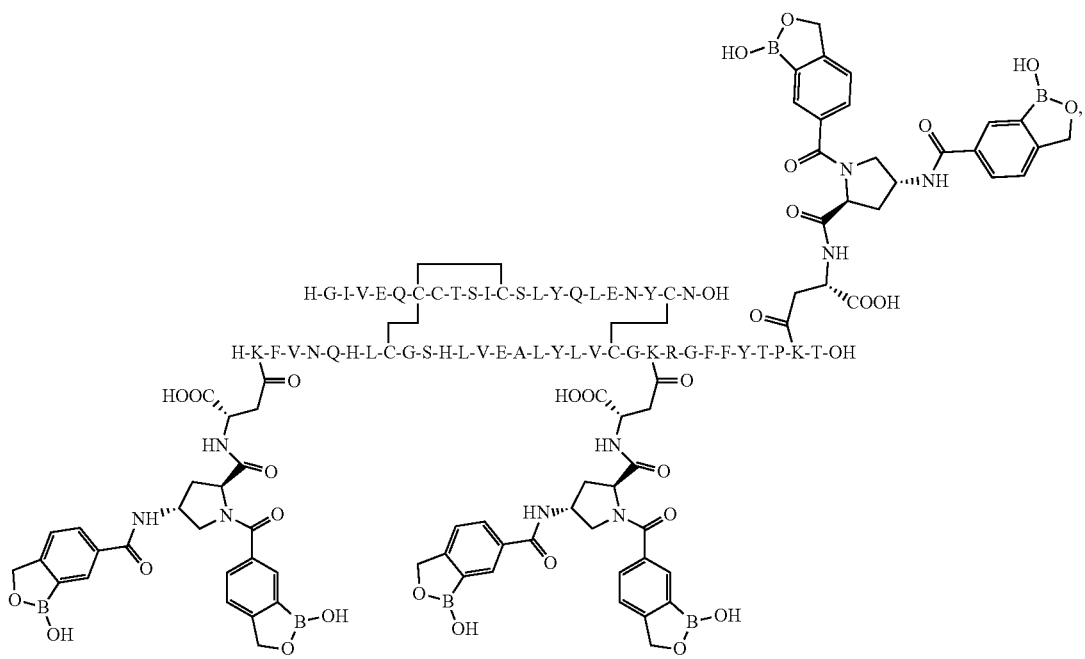
Example 29 (SEQ ID NOS 25452 and 25453, respectively, in order of appearance):

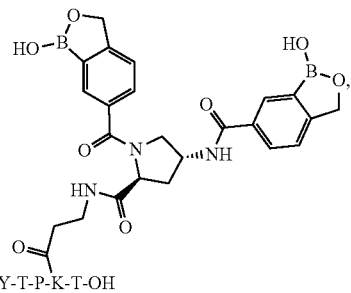
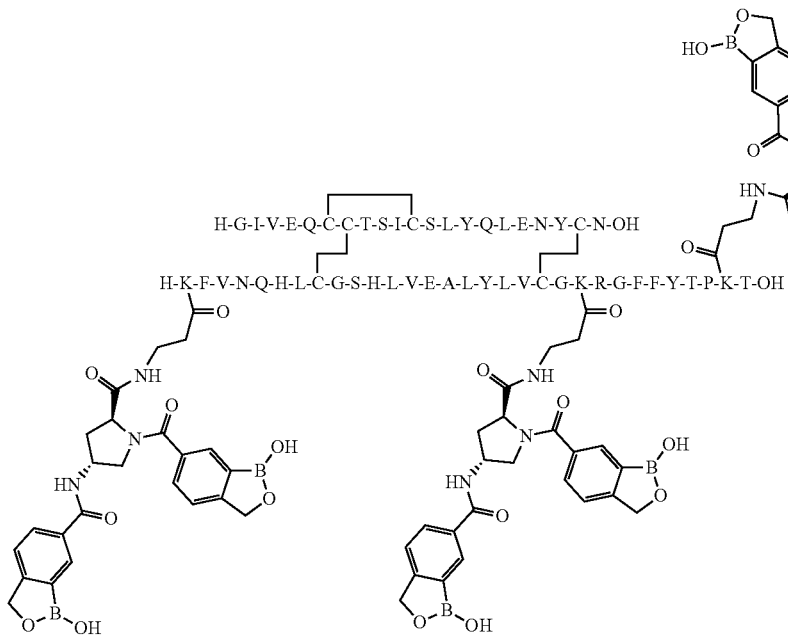
Example 30 (SEQ ID NOS 25454 and 25455, respectively, in order of appearance):
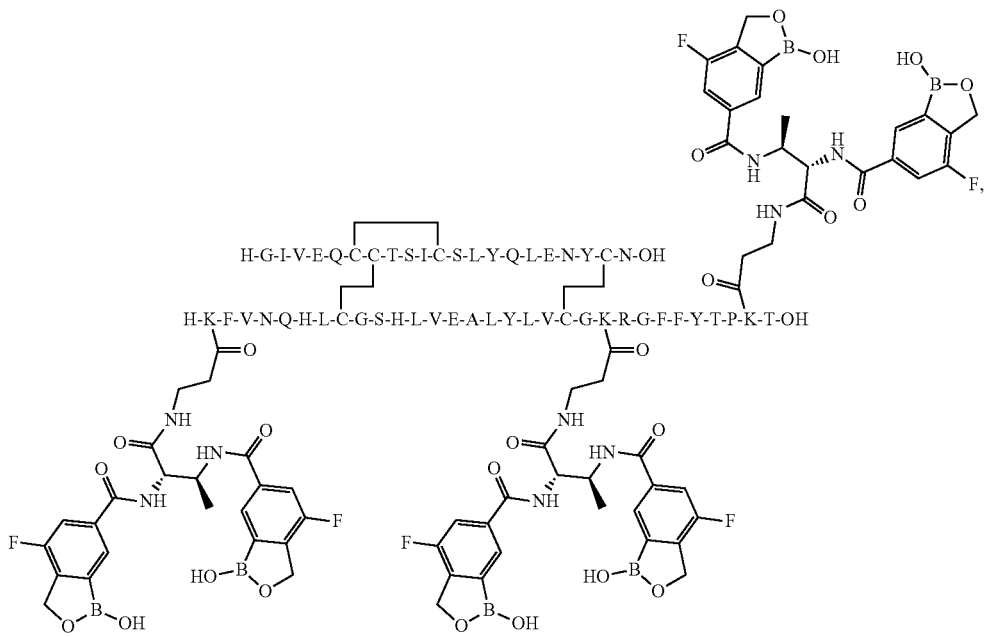
Example 31 (SEQ ID NOS 25456 and 25457, respectively, in order of appearance):

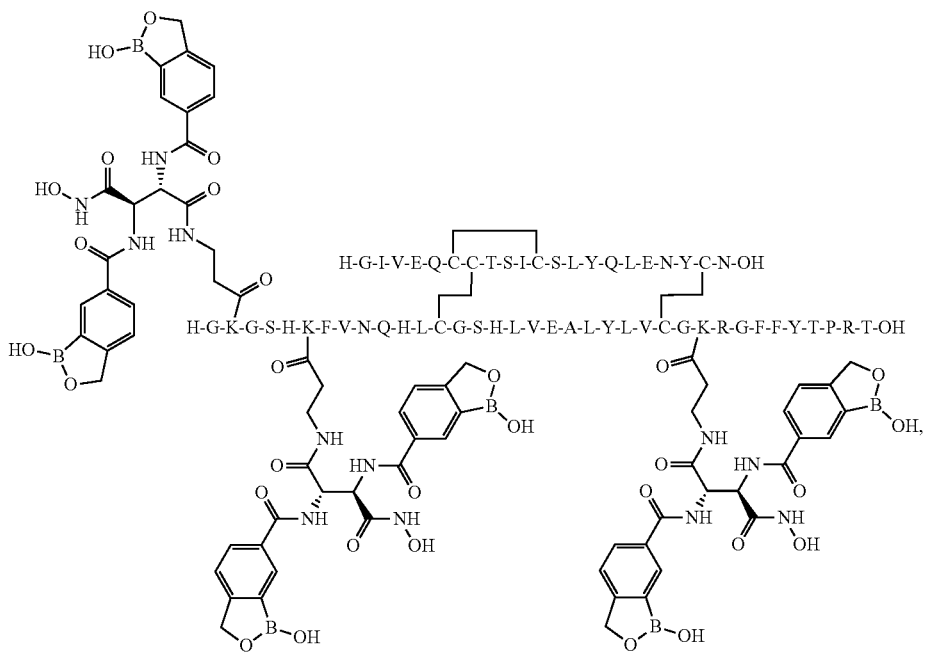
Example 32 (SEQ ID NOS 25458 and 25459, respectively, in order of appearance):
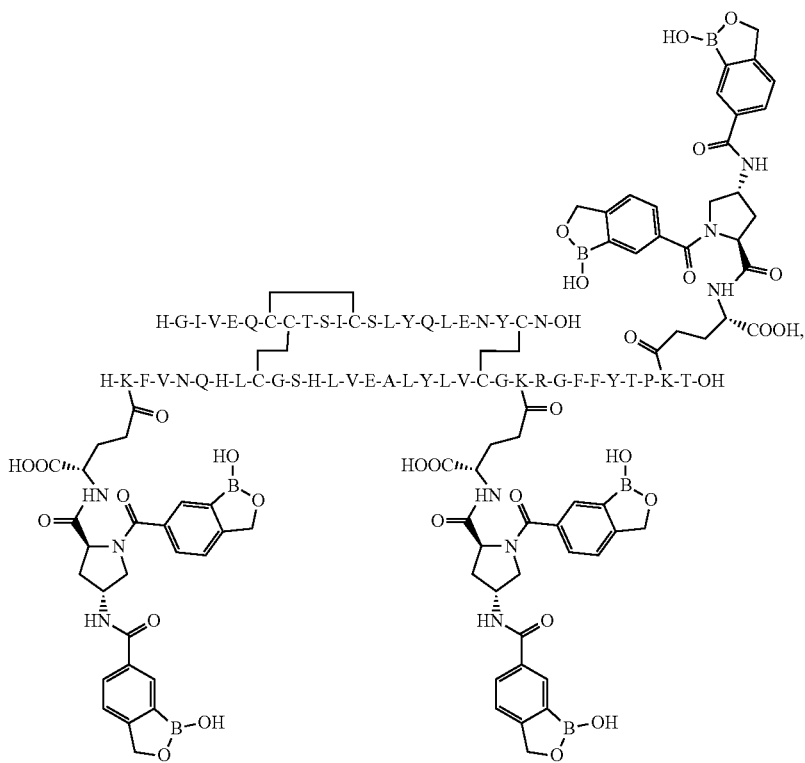
Example 33 (SEQ ID NOS 25460 and 25461, respectively, in order of appearance):

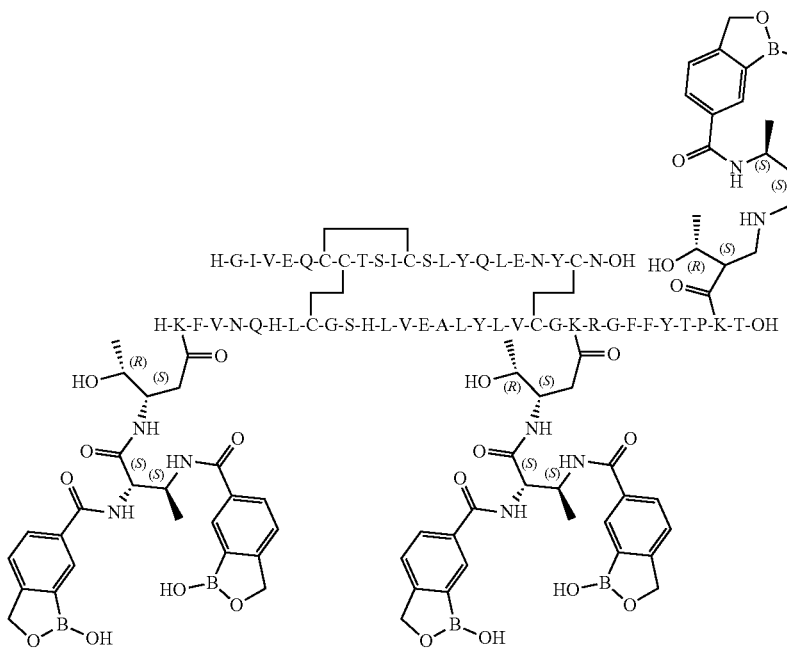
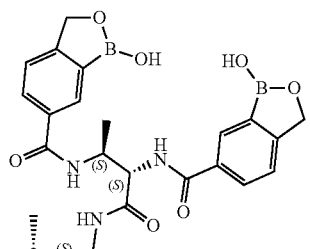
Example 34 (SEQ ID NOS 25462 and 25463, respectively, in order of appearance):
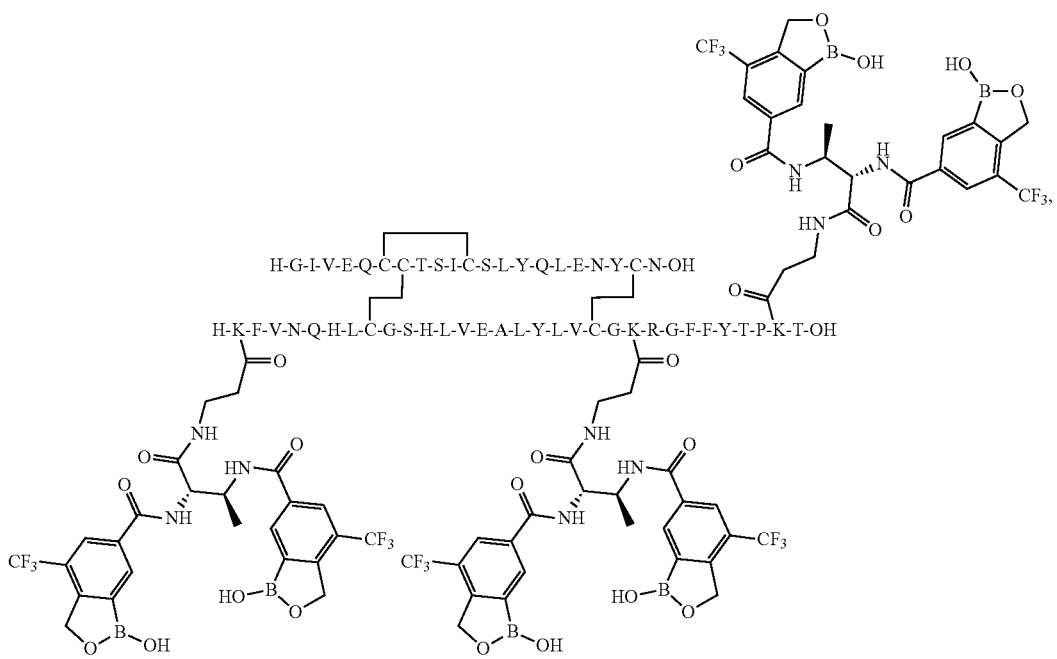
Example 35 (SEQ ID NOS 25464 and 25465, respectively, in order of appearance):

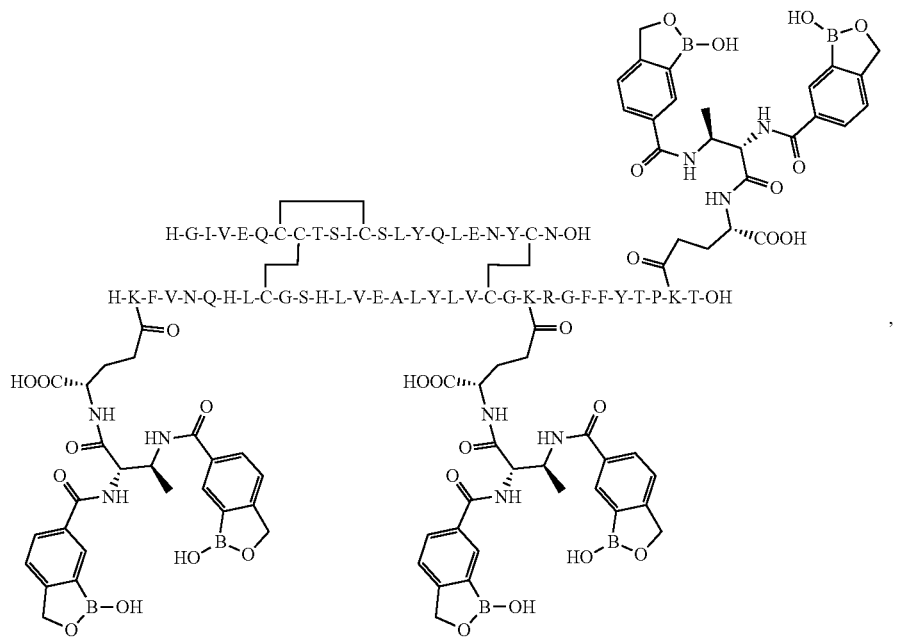
Example 36 (SEQ ID NOS 25466 and 25467, respectively, in order of appearance):
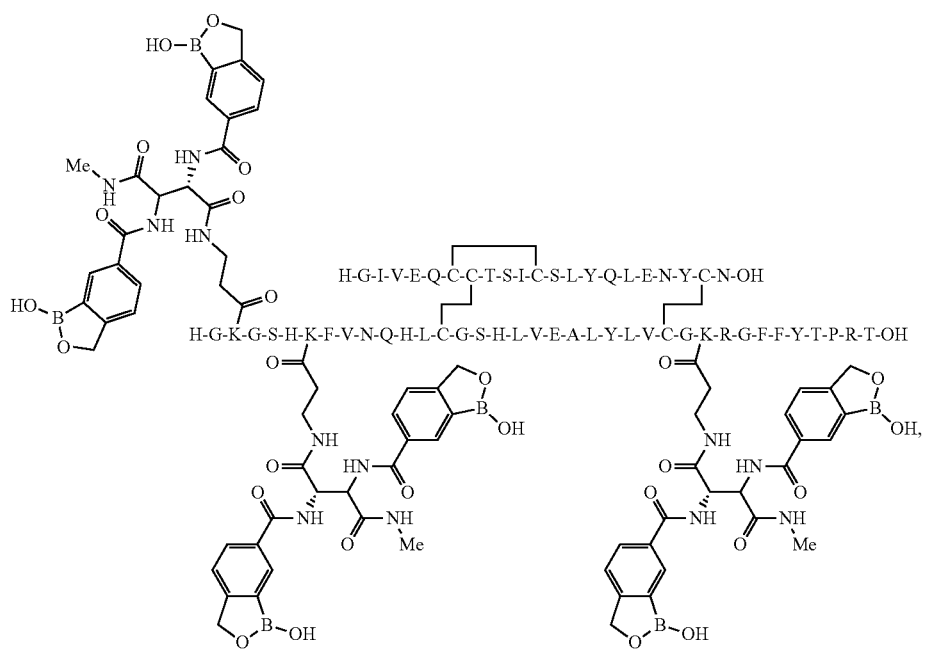
Example 37 (SEQ ID NOS 25468 and 25469, respectively, in order of appearance):

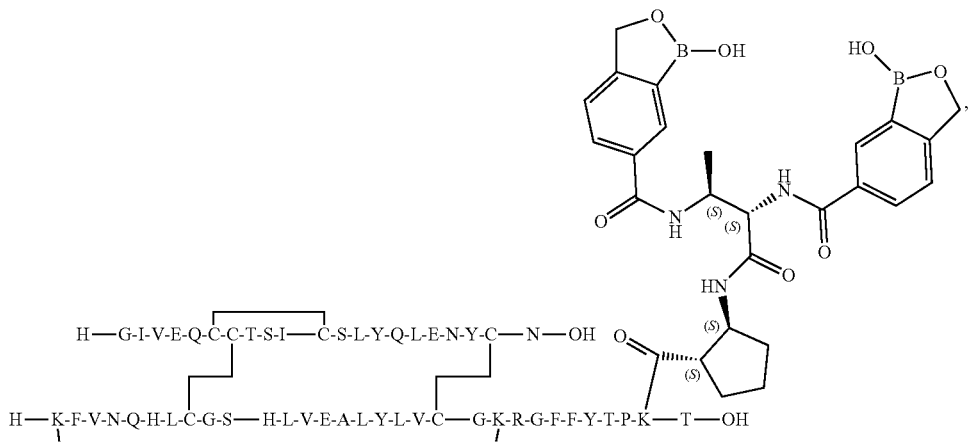
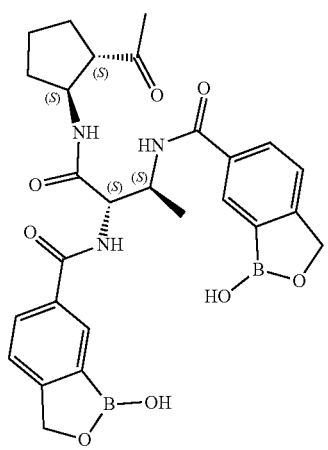
Example 38 (SEQ ID NOS 25470 and 25471, respectively, in order of appearance):
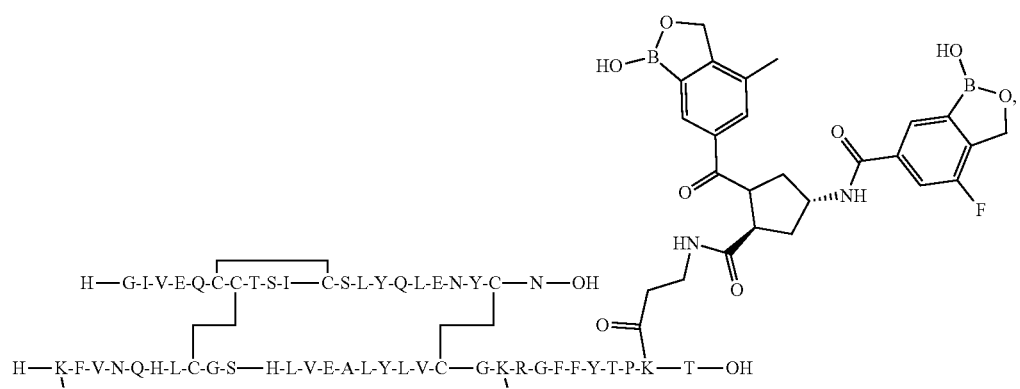

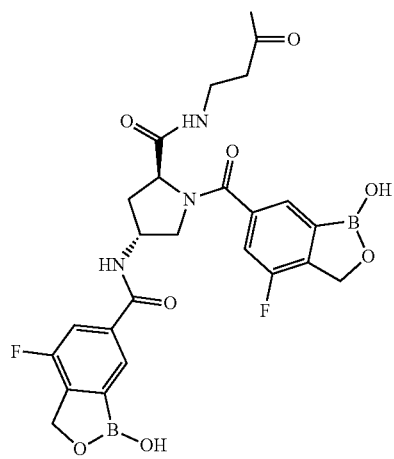
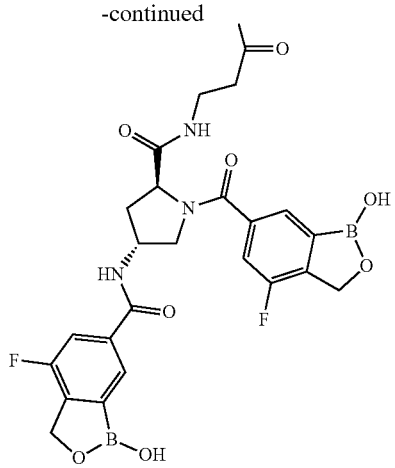
Example 39 (SEQ ID NOS 25472 and 25473, respectively, in order of appearance):
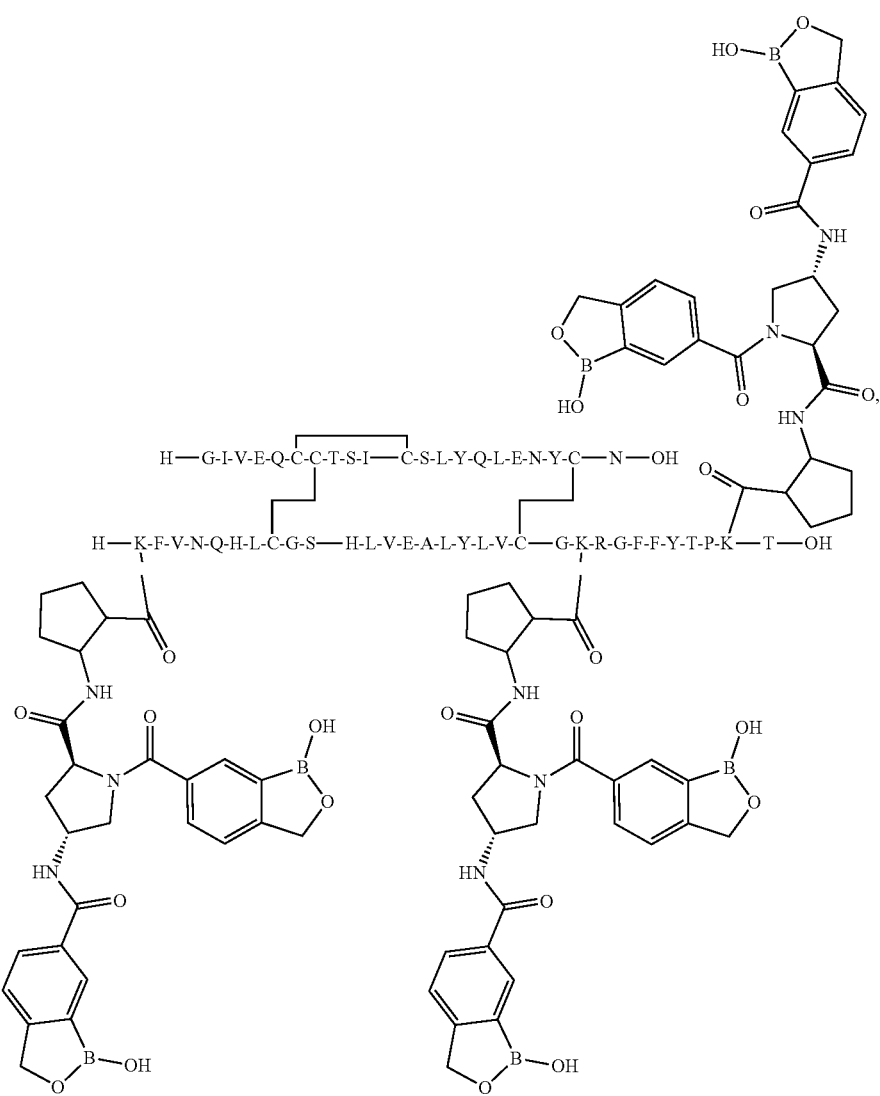

Example 40 (SEQ ID NOS 25474 and 25475, respectively, in order of appearance):
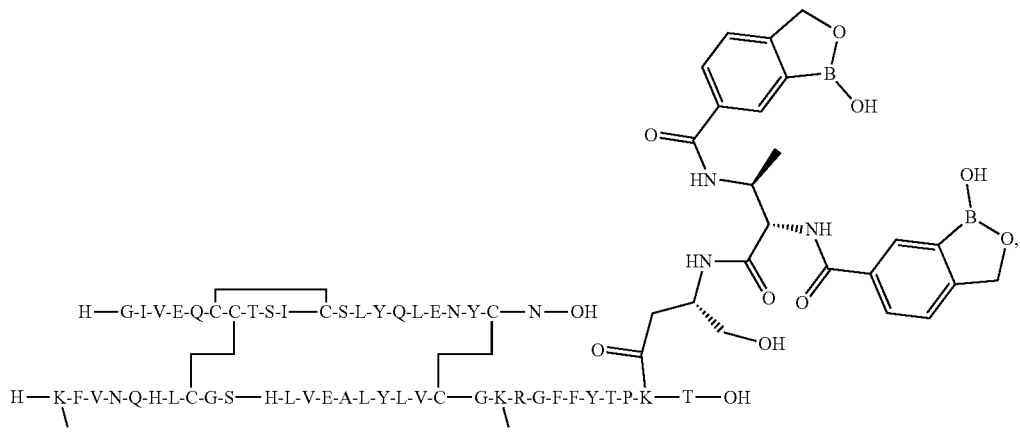
Example 41 (SEQ ID NOS 25476 and 25477, respectively, in order of appearance):
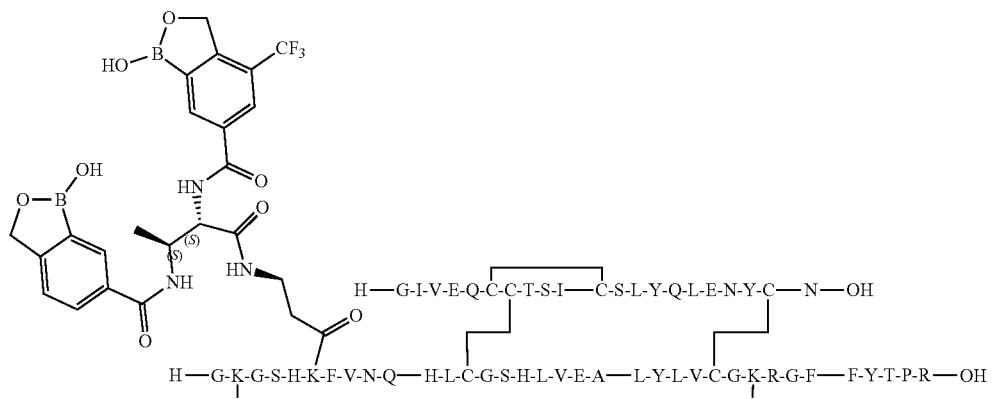

153
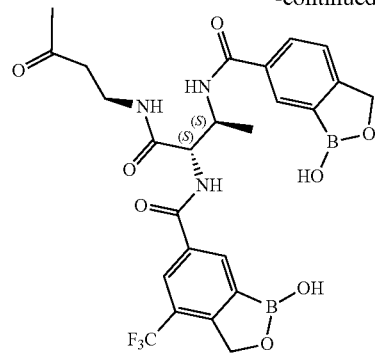
154
-continued
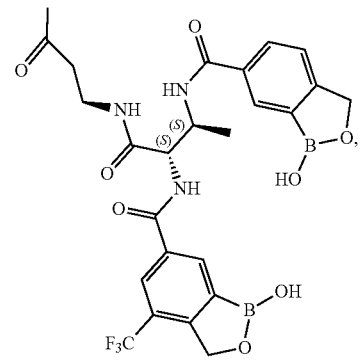
Example 42 (SEQ ID NOS 25478 and 25479, respectively, in order of appearance):
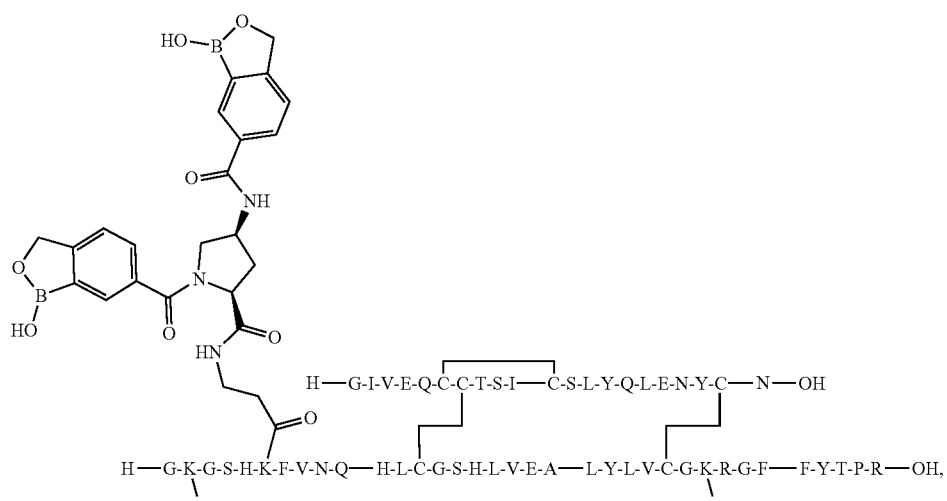
Example 43 (SEQ ID NOS 25480 and 25481, respectively, in order of appearance):
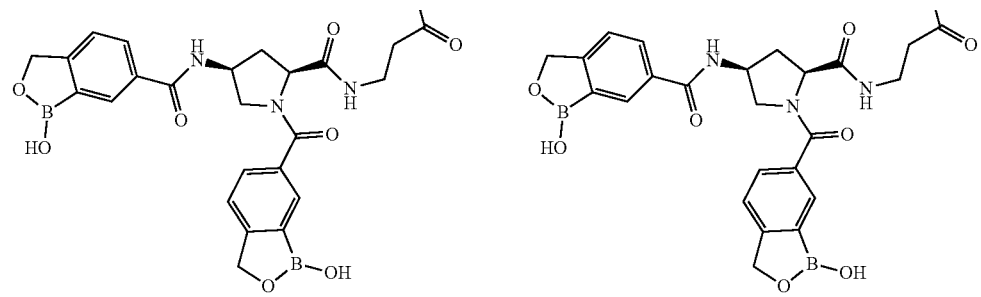

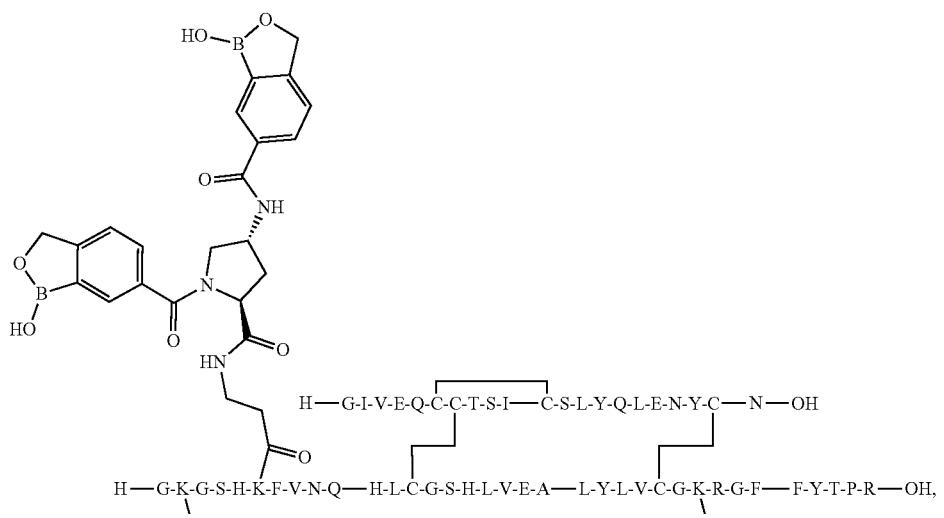
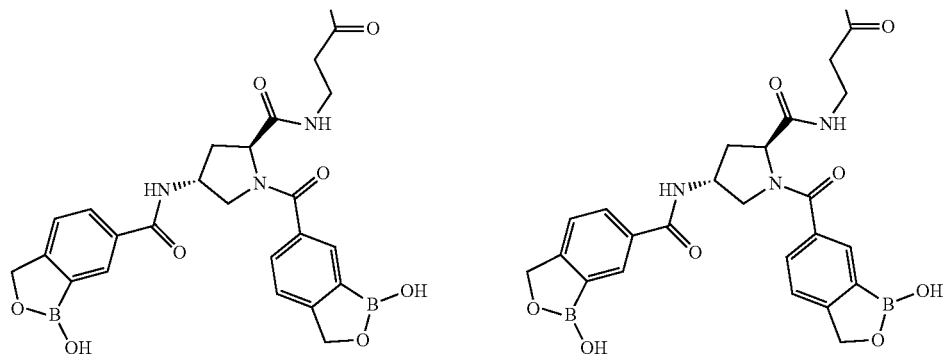
Example 44 (SEQ ID NOS 25482 and 25483, respectively, in order of appearance):
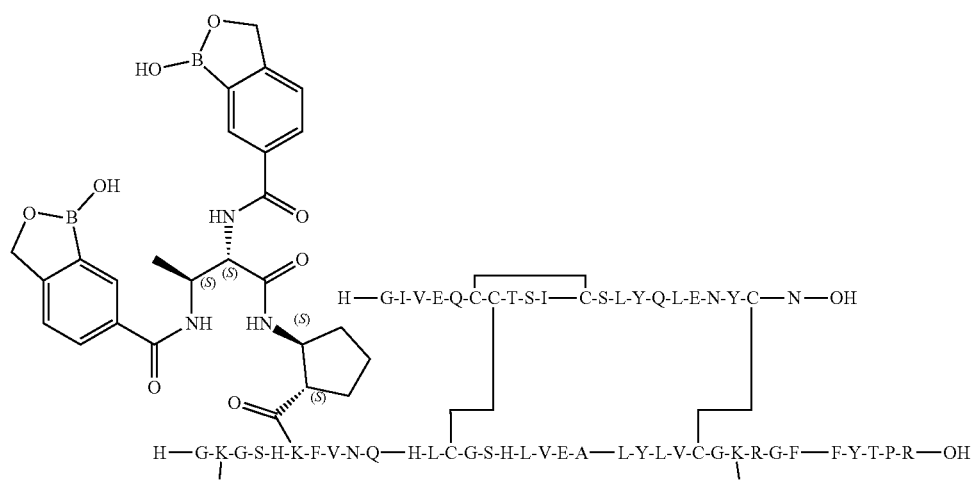

157
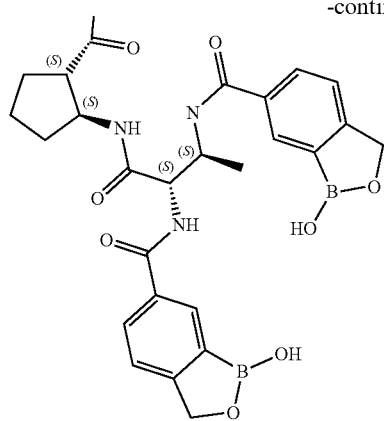
158
-continued
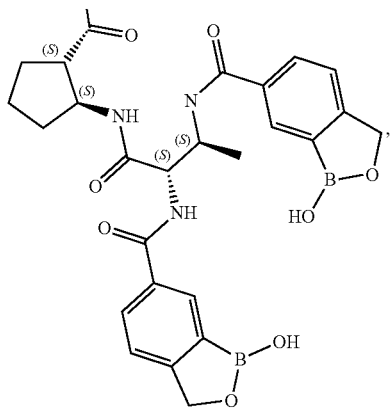
Example 45 (SEQ ID NOS 25484 and 25485, respectively, in order of appearance):
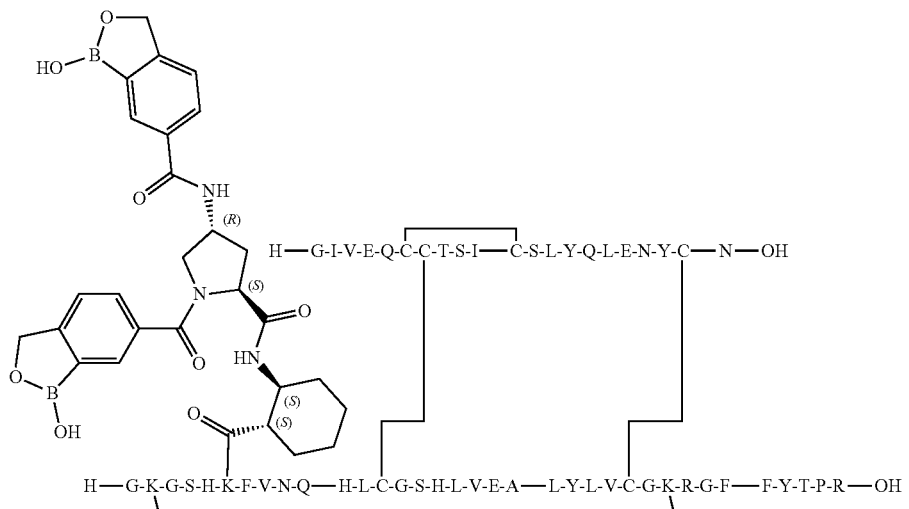
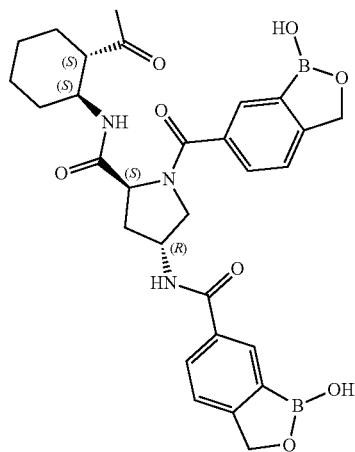
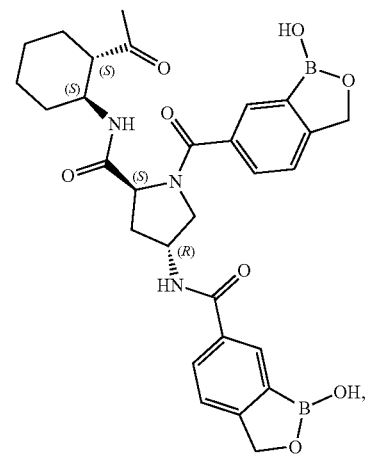
Example 46 (SEQ ID NOS 25486 and 25487, respectively, in order of appearance):

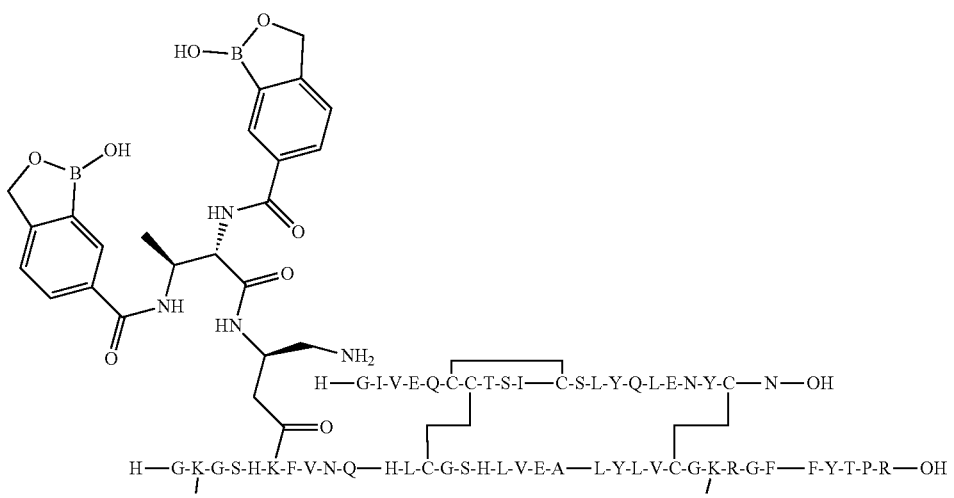
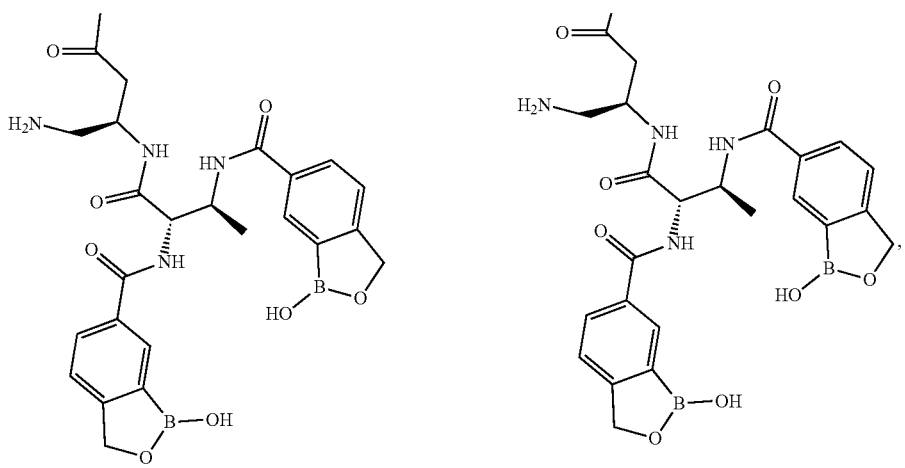
Example 47 (SEQ ID NOS 25488 and 25489, respectively, in order of appearance):
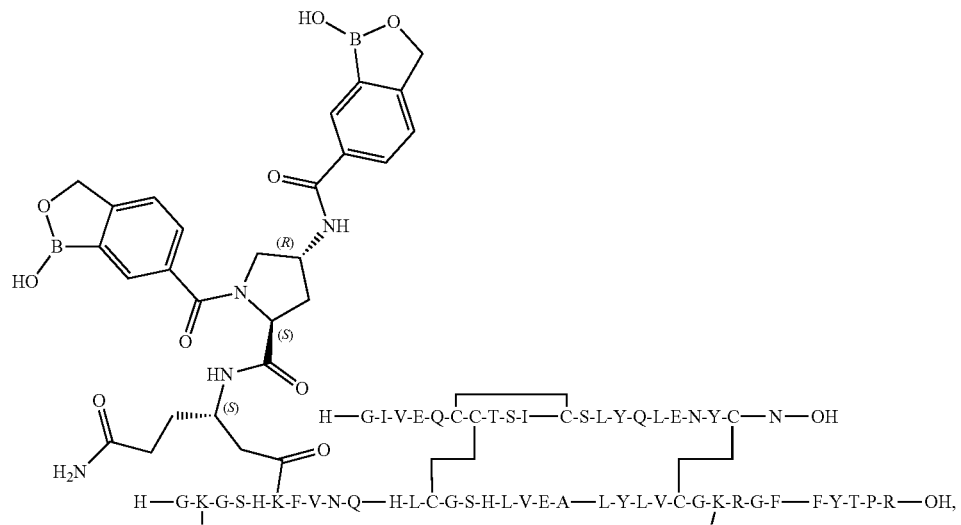

161 162
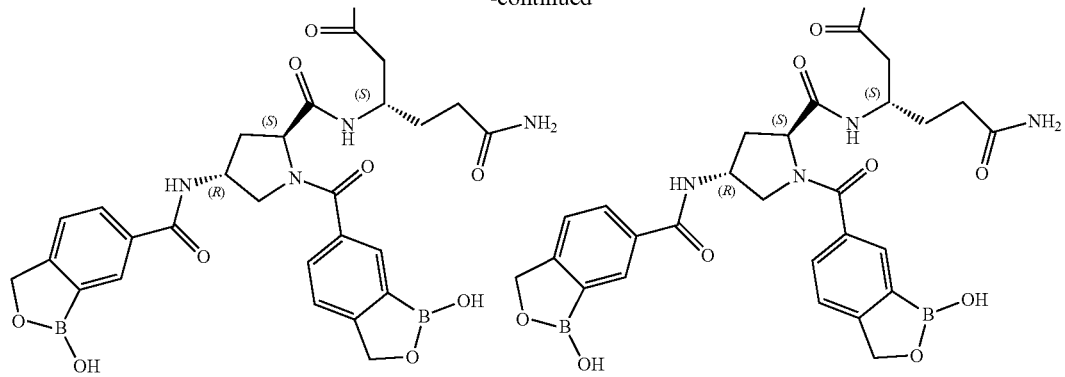
Example 48 (SEQ ID NOS 25490 and 25491, respectively, in order of appearance):
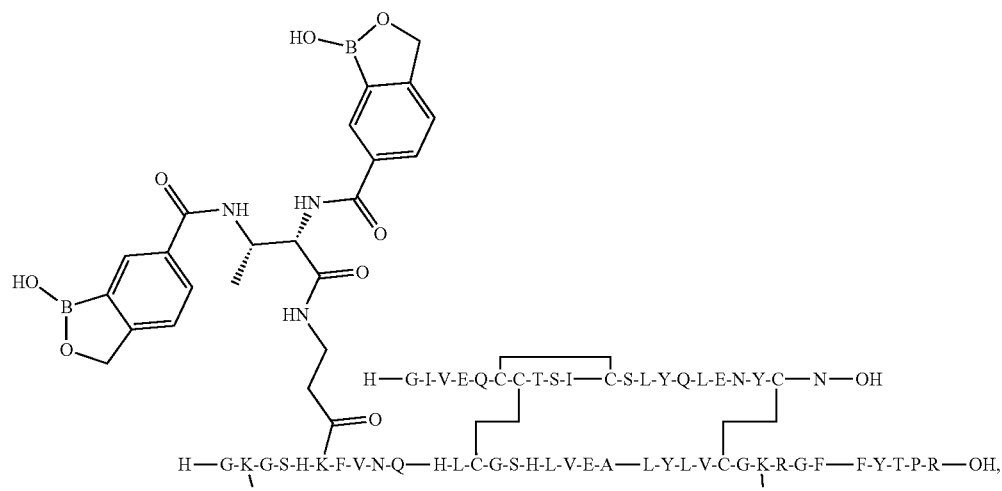
Example 49 (SEQ ID NOS 25492 and 25493, respectively, in order of appearance):
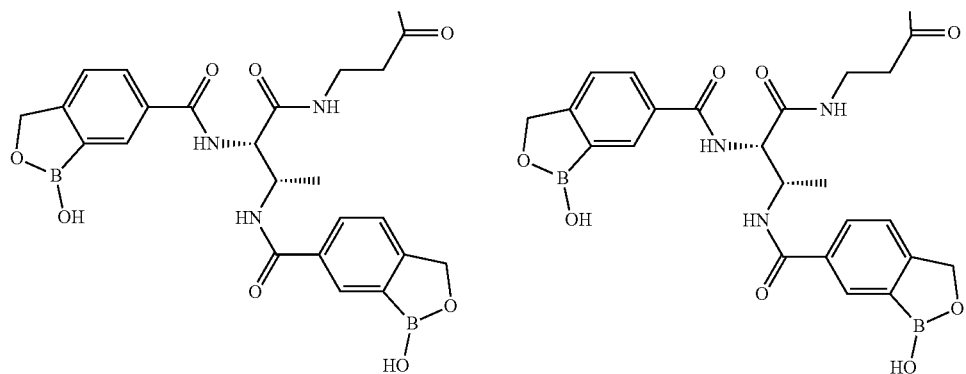

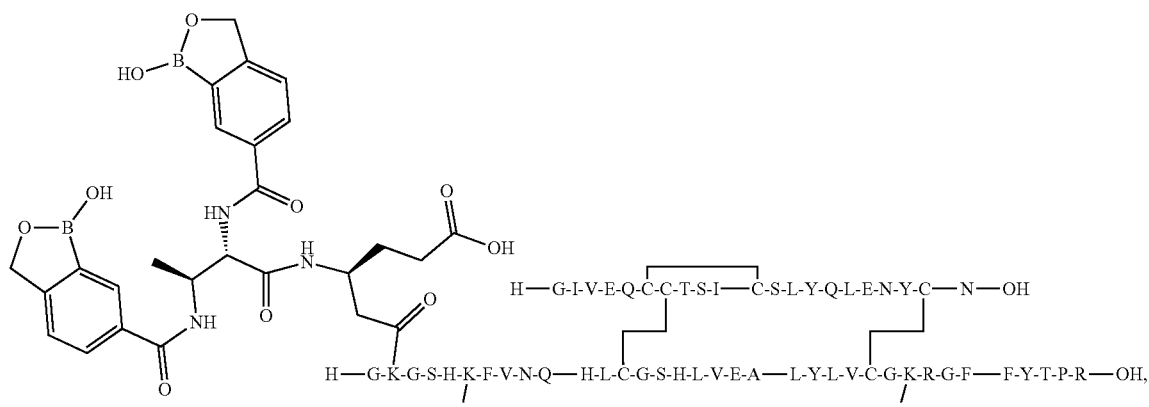
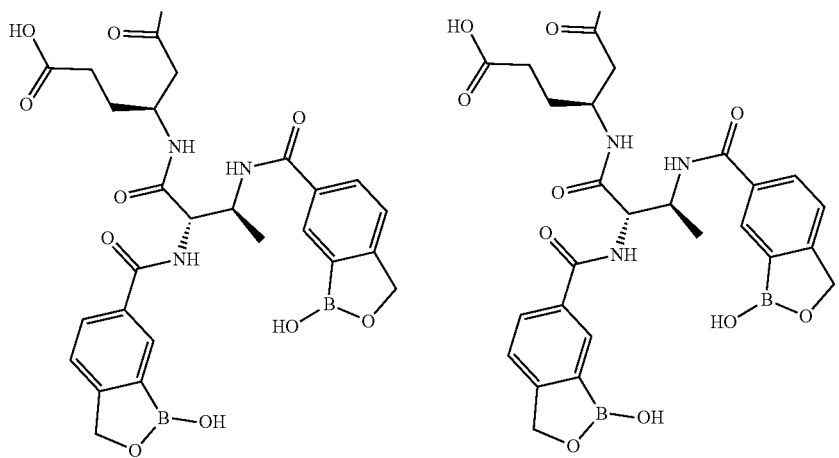
Example 50 (SEQ ID NOS 25494 and 25495, respectively, in order of appearance):
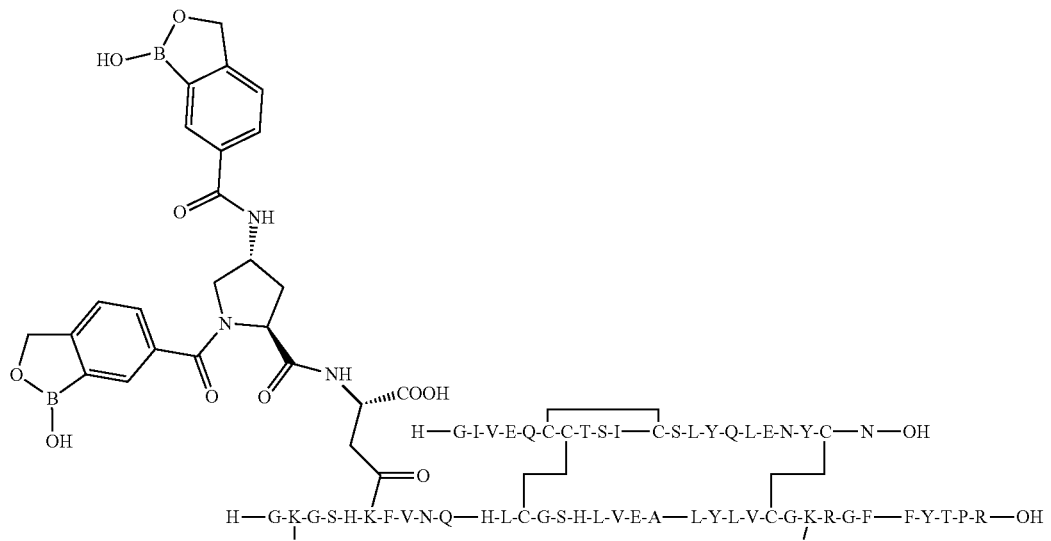

165 166
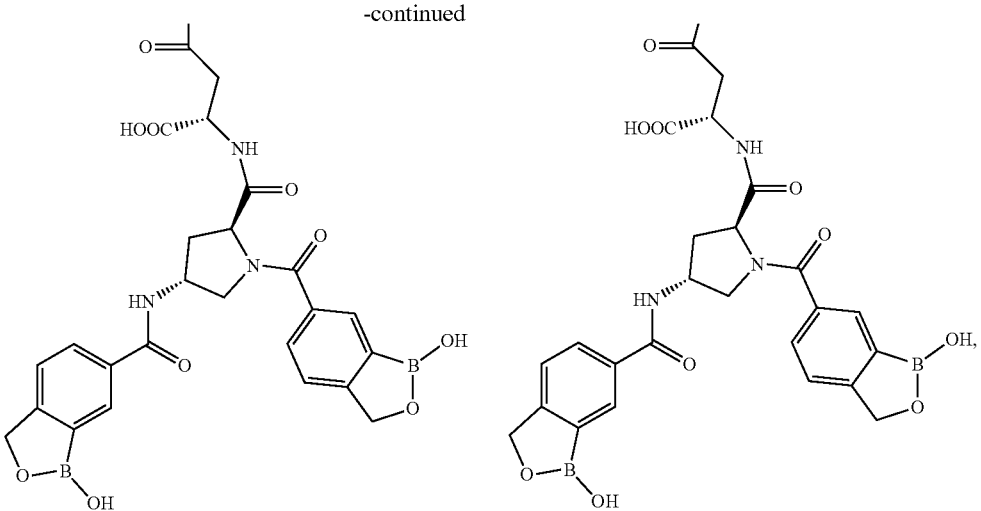
-continued
Example 51 (SEQ ID NOS 25496 and 25497, respectively, in order of appearance):
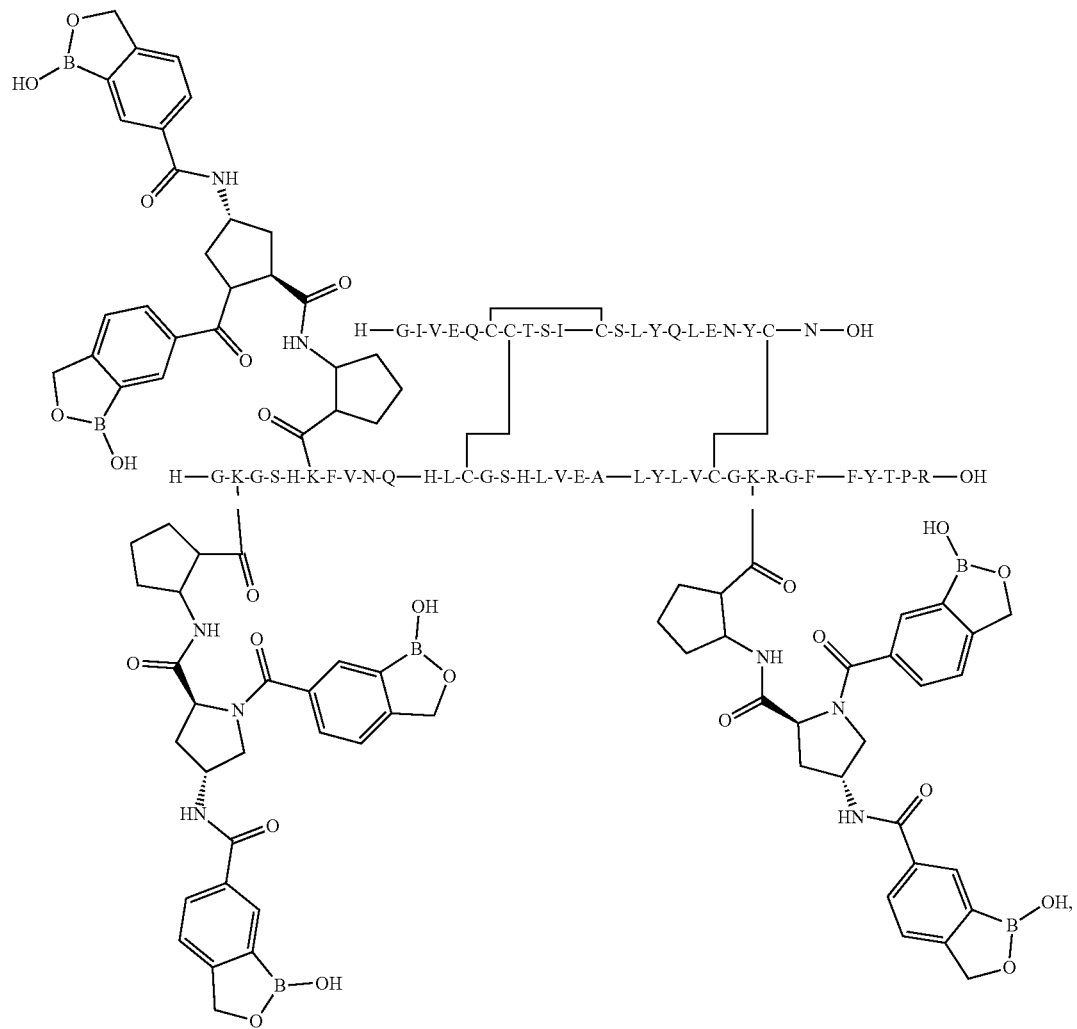

Example 52 (SEQ ID NOS 25498 and 25499, respectively, in order of appearance):
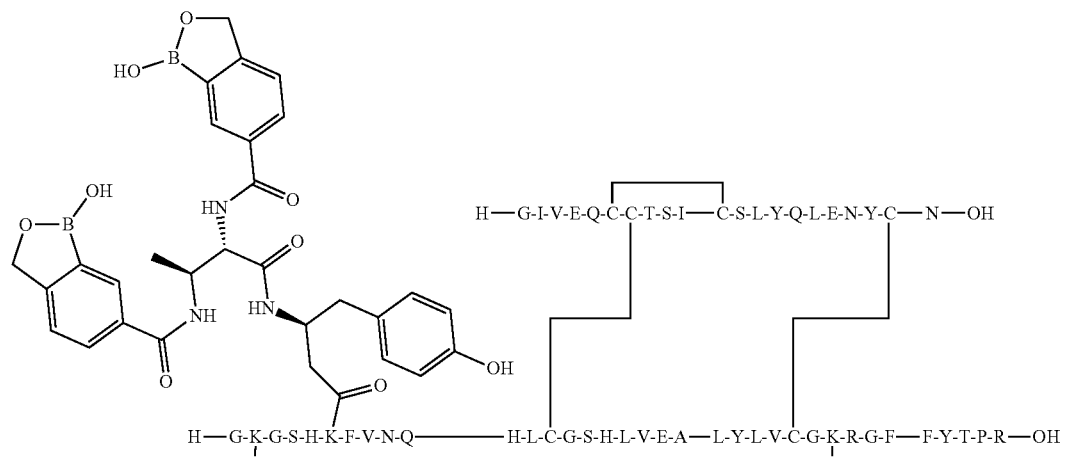
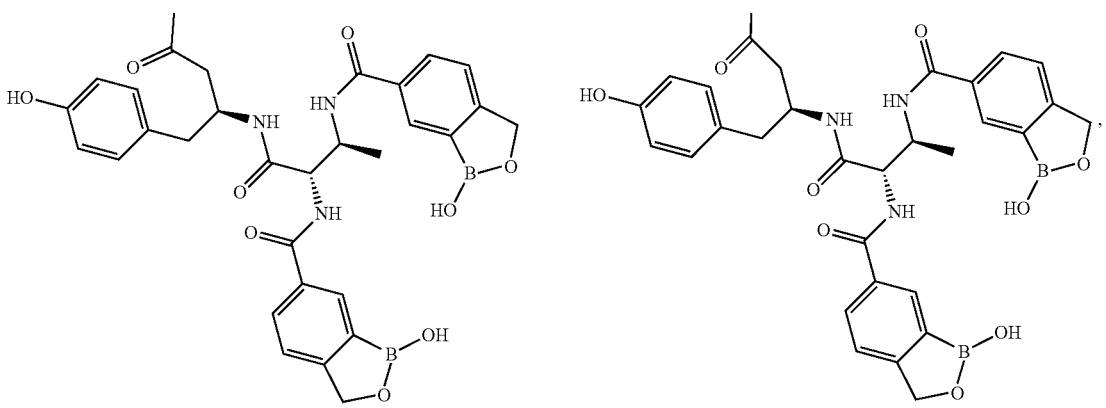
Example 53 (SEQ ID NOS 25500 and 25501, respectively, in order of appearance):
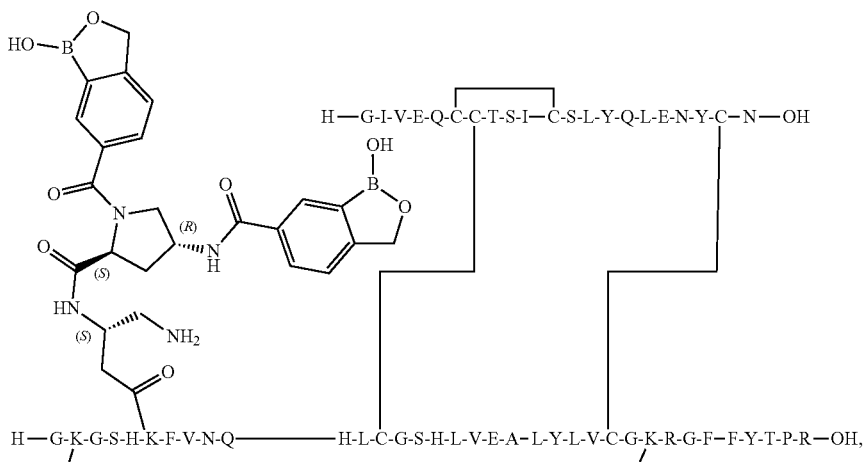

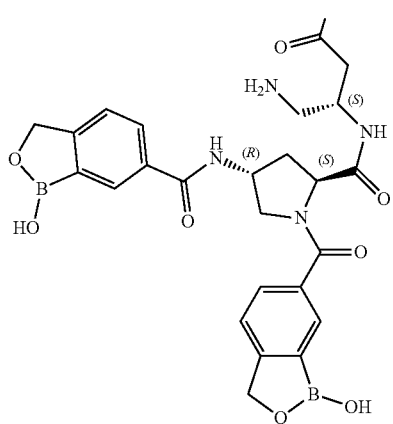
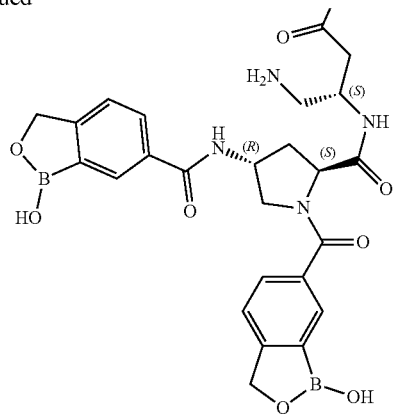
Example 54 (SEQ ID NOS 25502 and 25503, respectively, in order of appearance):
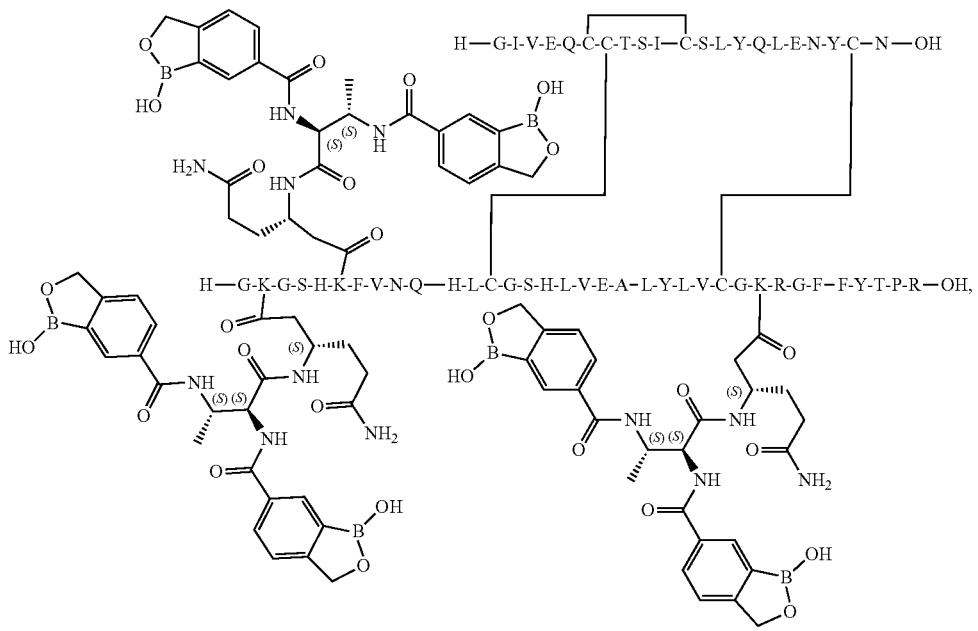
Example 55 (SEQ ID NOS 25504 and 25505, respectively, in order of appearance):

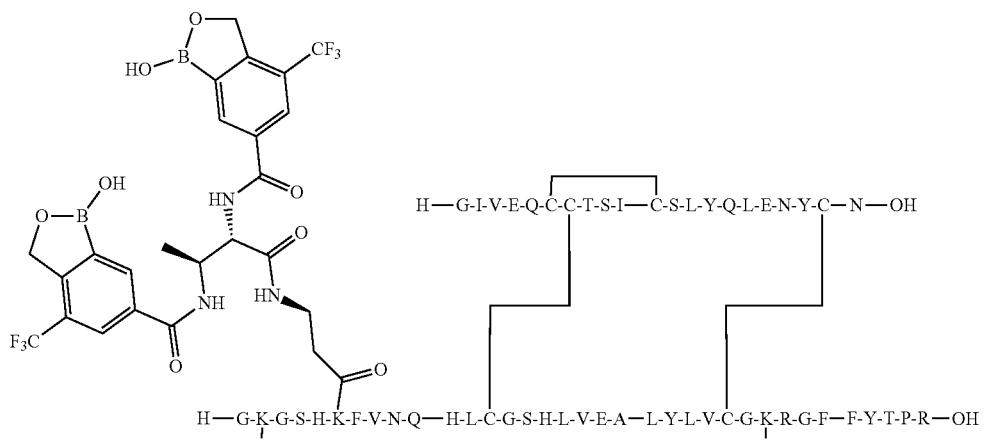
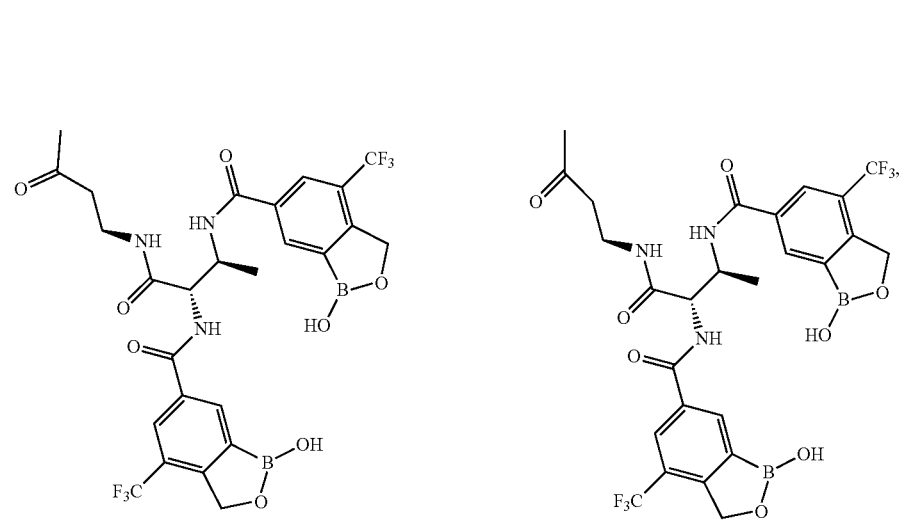
Example 56 (SEQ ID NOS 25506 and 25507, respectively, in order of appearance):
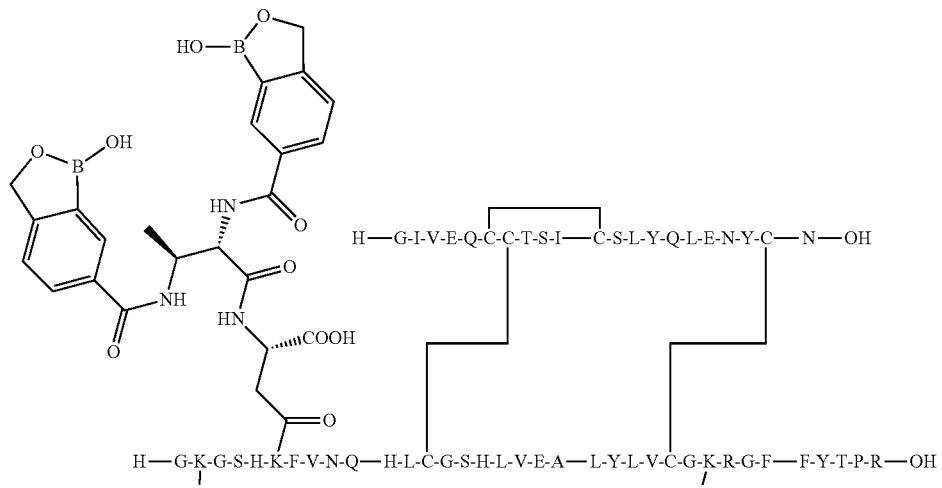

173 174
-continued
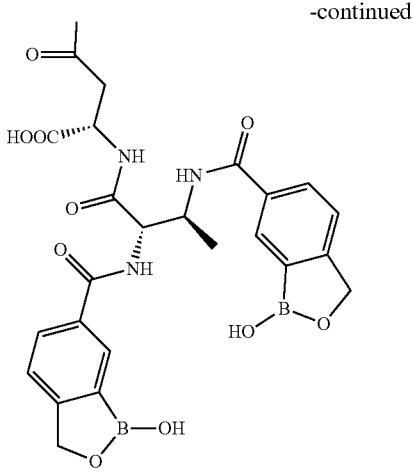
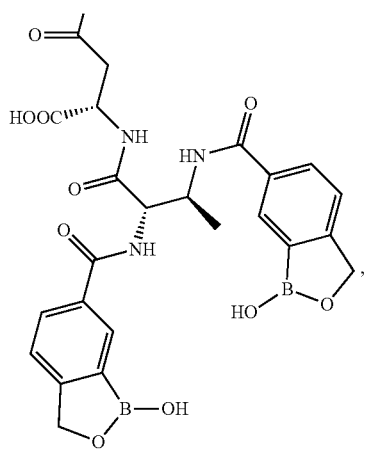
Example 57 (SEQ ID NOS 25508 and 25509, respectively, in order of appearance):
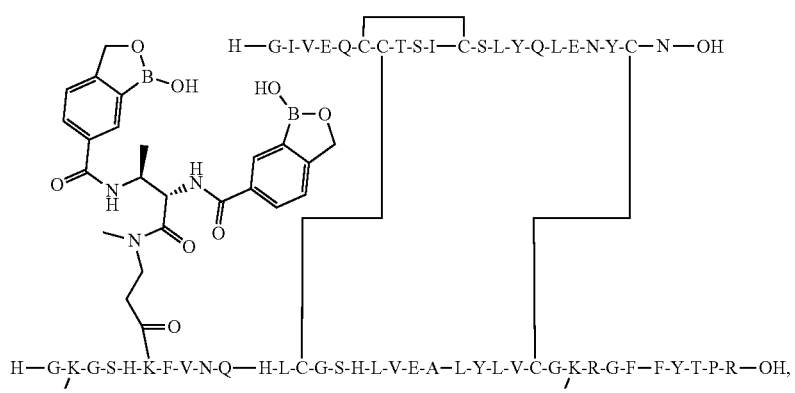
Example 58 (SEQ ID NOS 25510 and 25511, respectively, in order of appearance):
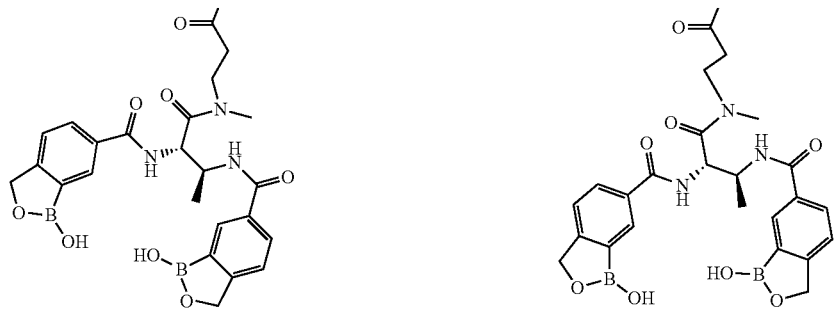

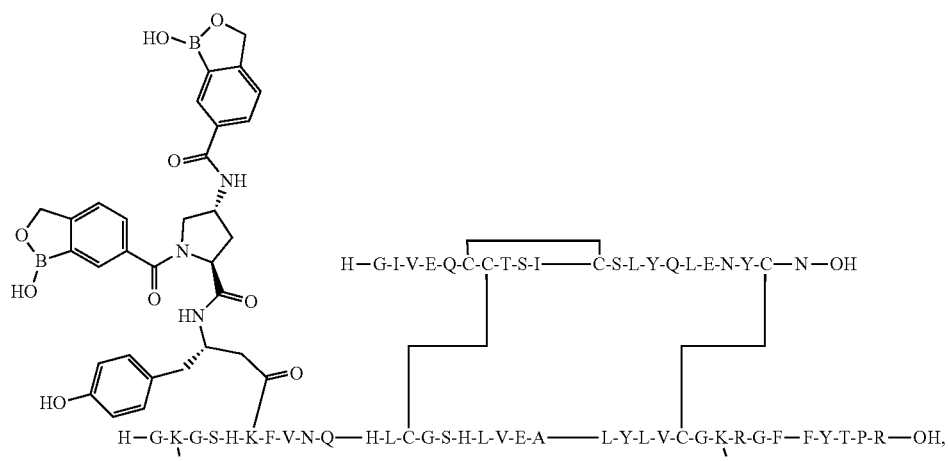
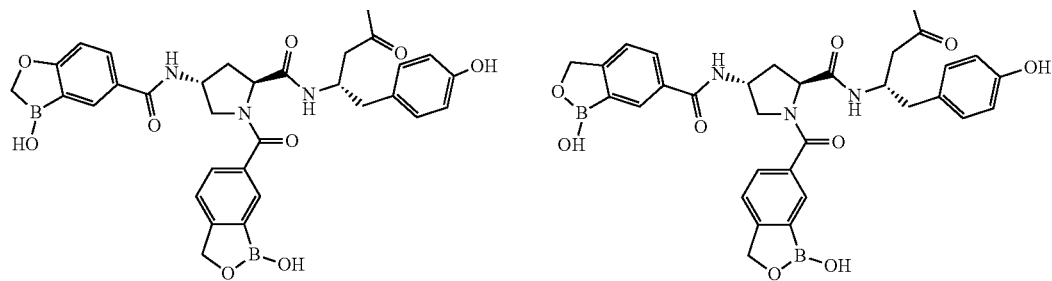
Example 59 (SEQ ID NOS 25512 and 25513, respectively, in order of appearance):
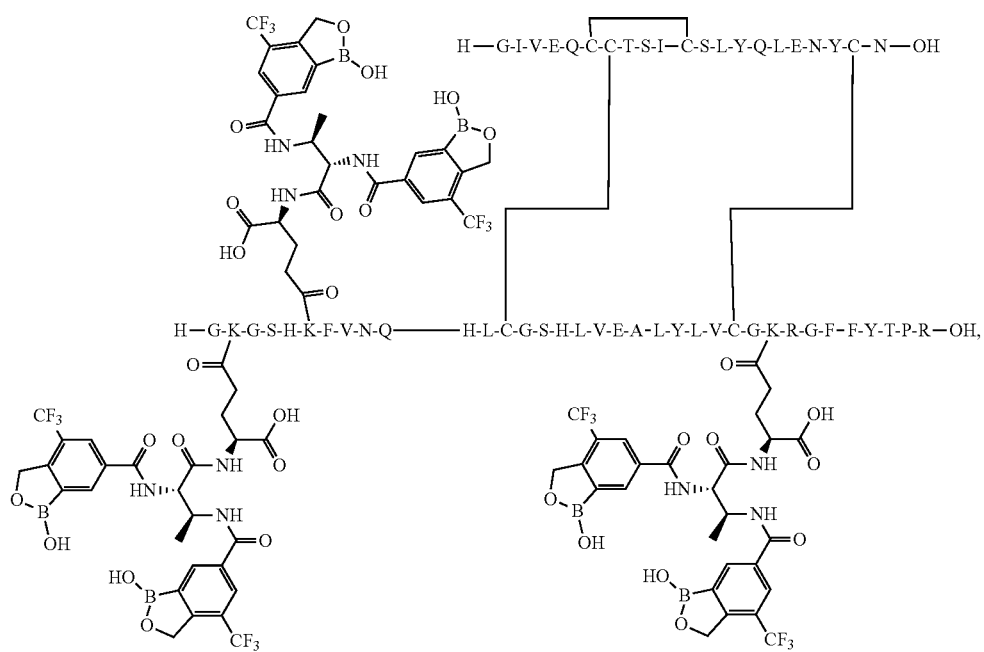
Example 60 (SEQ ID NOS 25514 and 25515, respectively, in order of appearance):

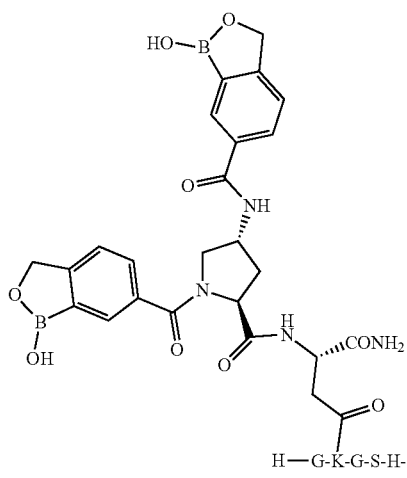
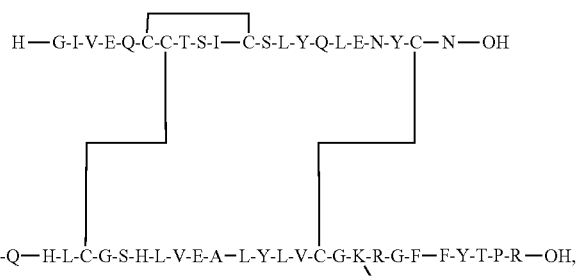
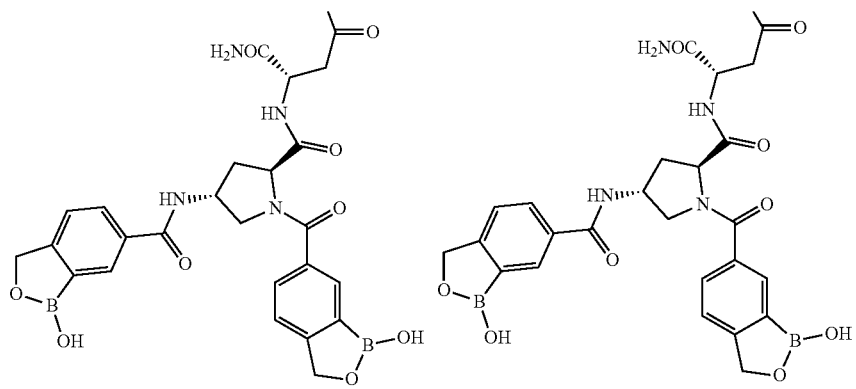
Example 61 (SEQ ID NOS 25480 and 25481, respectively, in order of appearance):
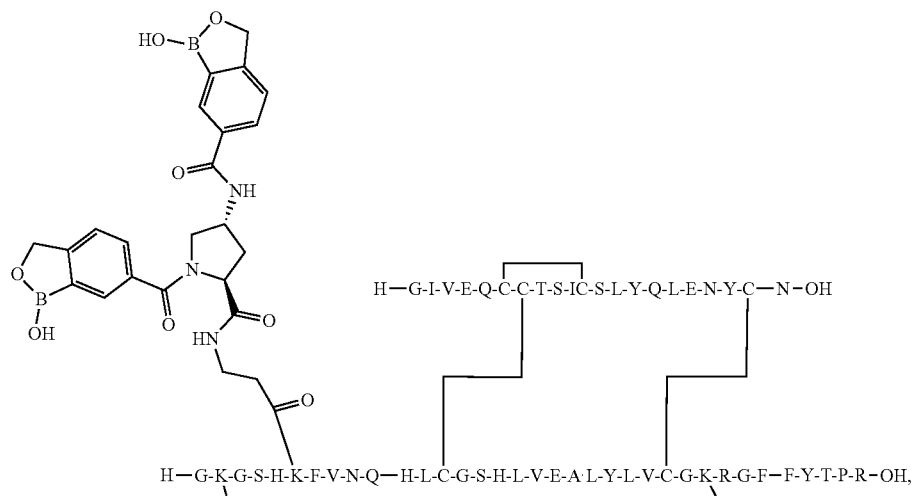

-continued
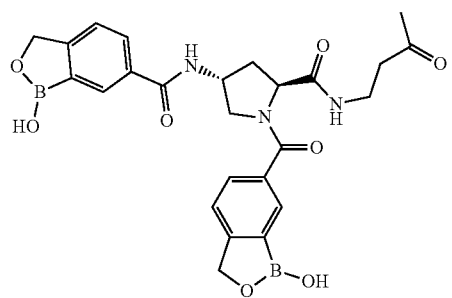
179
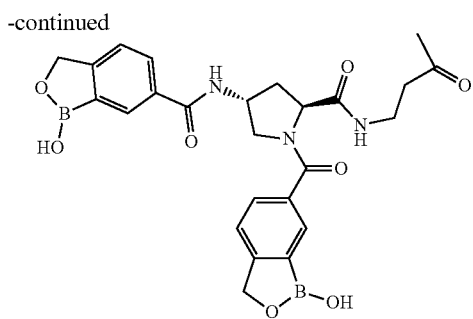
180
Example 62 (SEQ ID NOS 25516 and 25517, respectively, in order of appearance):
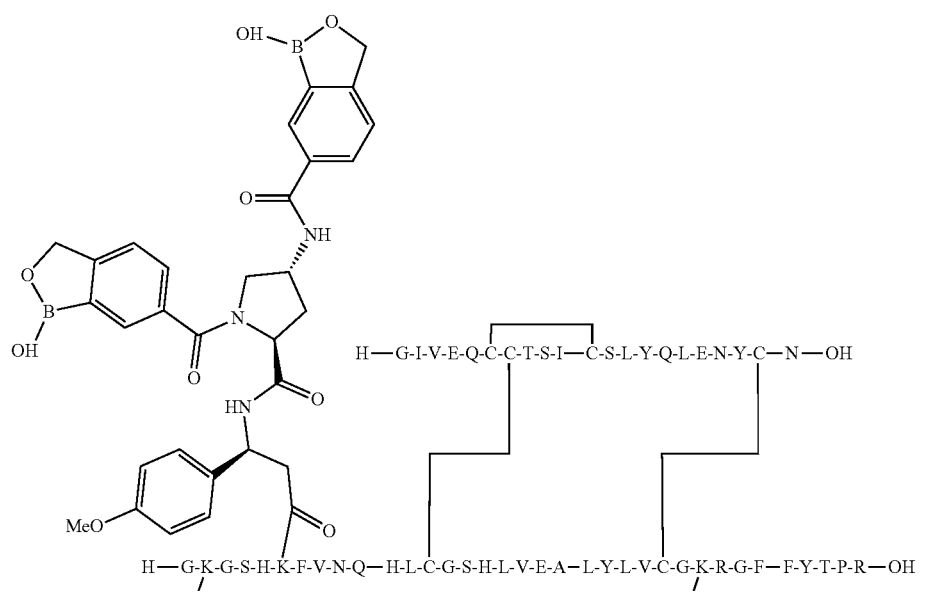
Example 63 (SEQ ID NOS 25518 and 25519, respectively, in order of appearance):
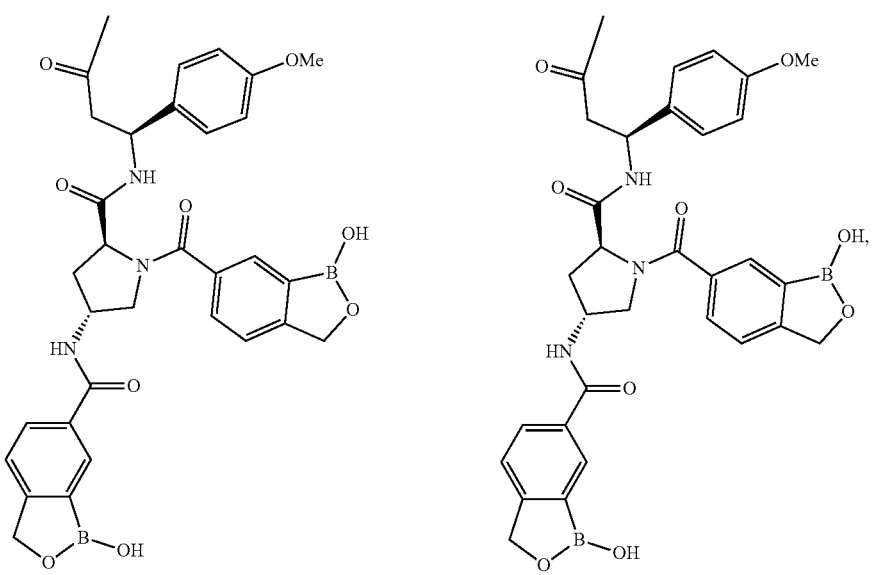

181 182
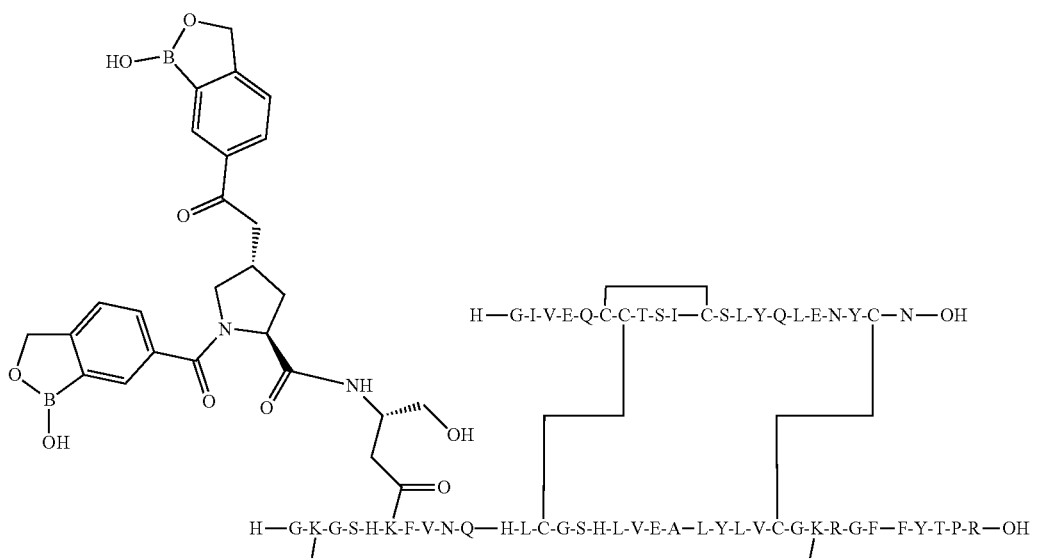
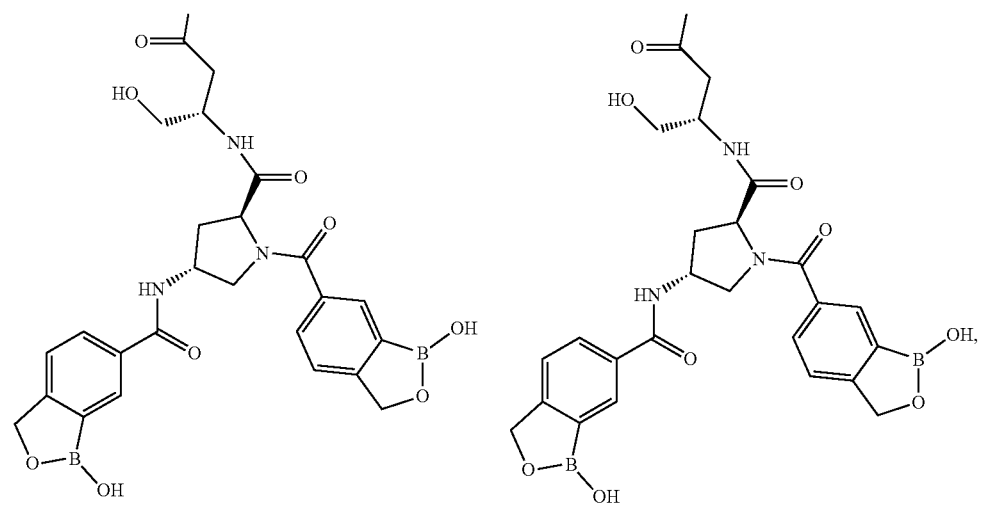
Example 64 (SEQ ID NOS 25520 and 25521, respectively, in order of appearance):
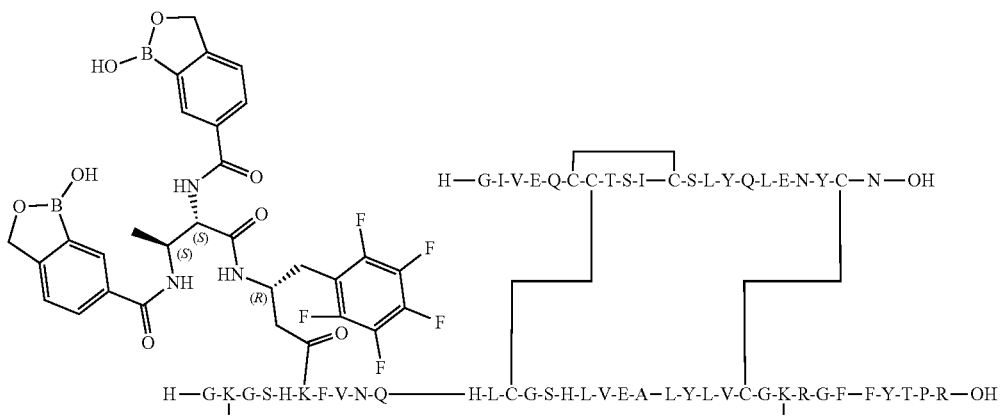

183 184
-continued
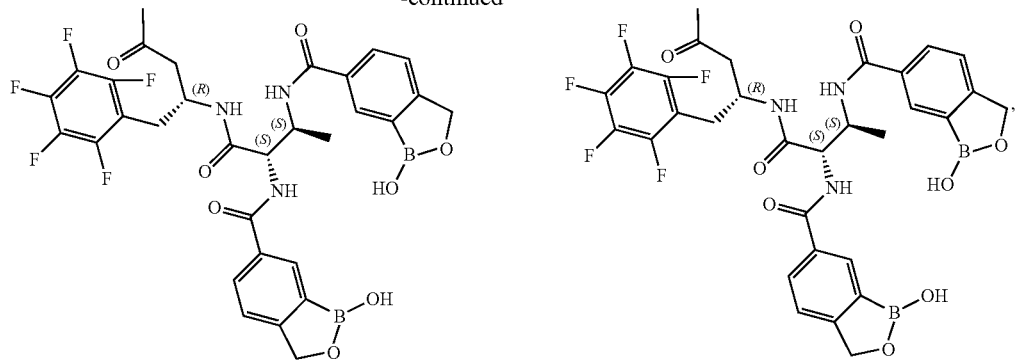
Example 65 (SEQ ID NOS 25522 and 25523, respectively, in order of appearance):
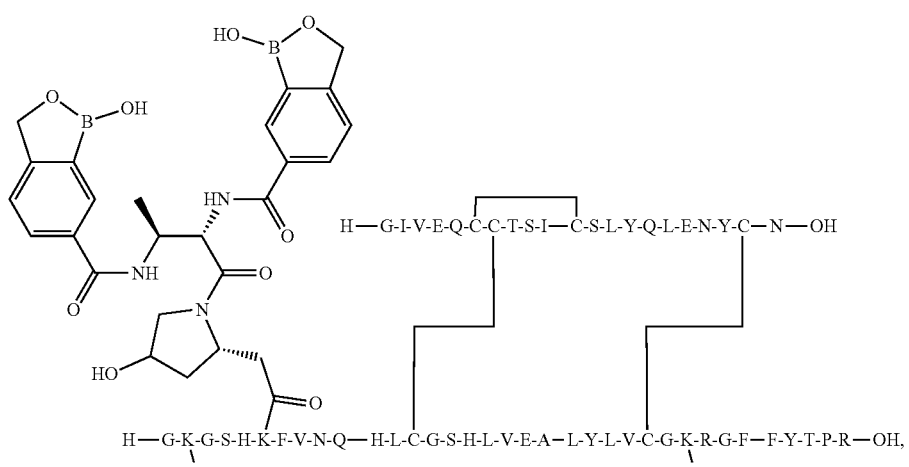
Example 66 (SEQ ID NOS 25524 and 25525, respectively, in order of appearance):
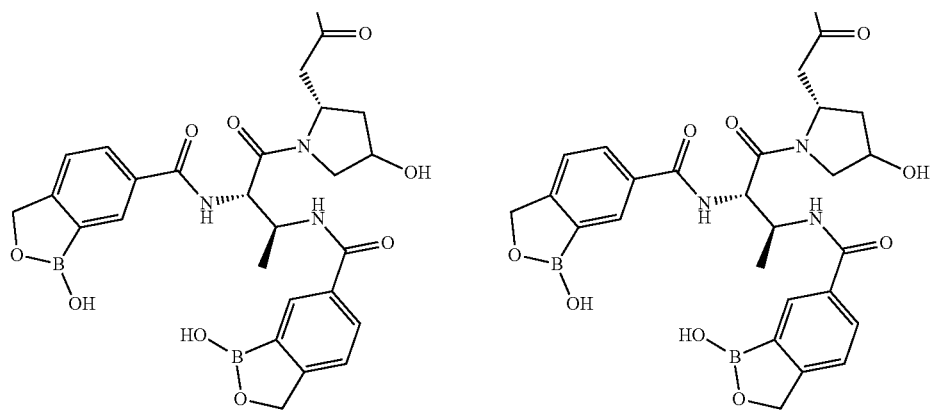

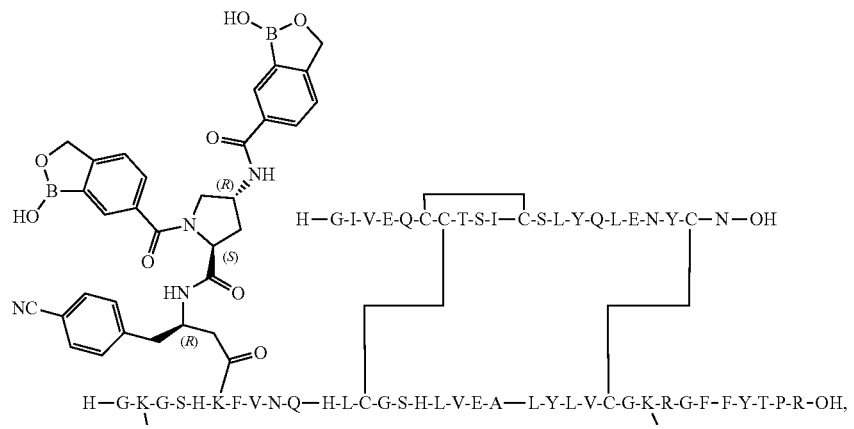
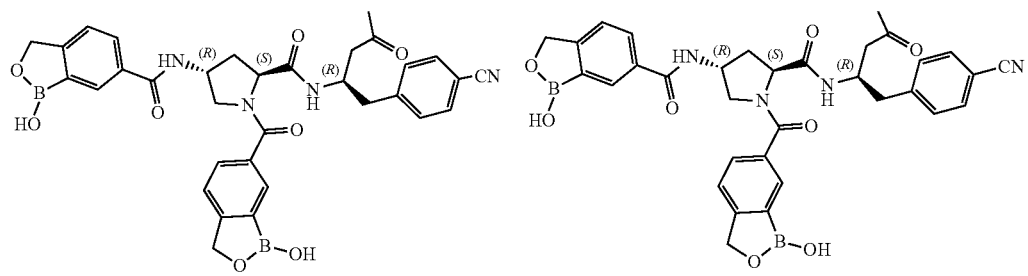
Example 67 (SEQ ID NOS 25526 and 25527, respectively, in order of appearance):
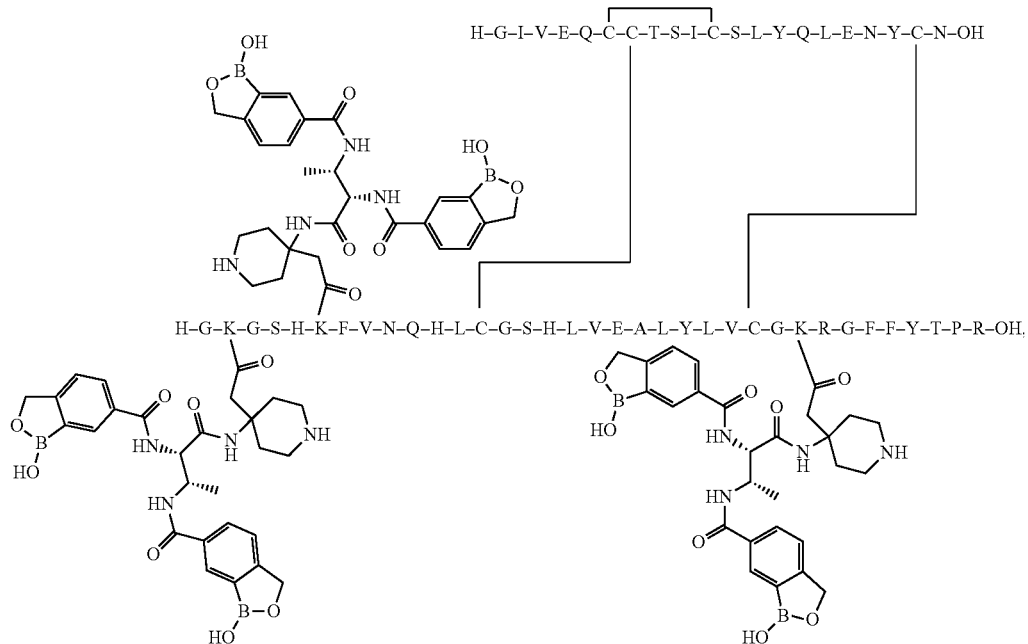 [SMILES: CC(=O)CC1(NC(=O)[C@@H](NC(=O)c2ccc3c(c2)B(O)OC3)[C@H](C)NC(=O)c2ccc3c(c2)B(O)OC3)CCNCC1 ; CC(=O)CC1(NC(=O)[C@@H](NC(=O)c2ccc3c(c2)B(O)OC3)[C@H](C)NC(=O)c2ccc3c(c2)B(O)OC3)CCNCC1 ; CC(=O)CC1(NC(=O)[C@@H](NC(=O)c2ccc3c(c2)B(O)OC3)[C@H](C)NC(=O)c2ccc3c(c2)B(O)OC3)CCNCC1]
Example 68 (SEQ ID NOS 25528 and 25529, respectively, in order of appearance):

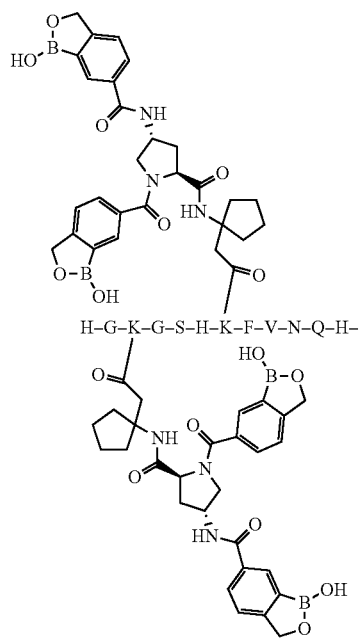
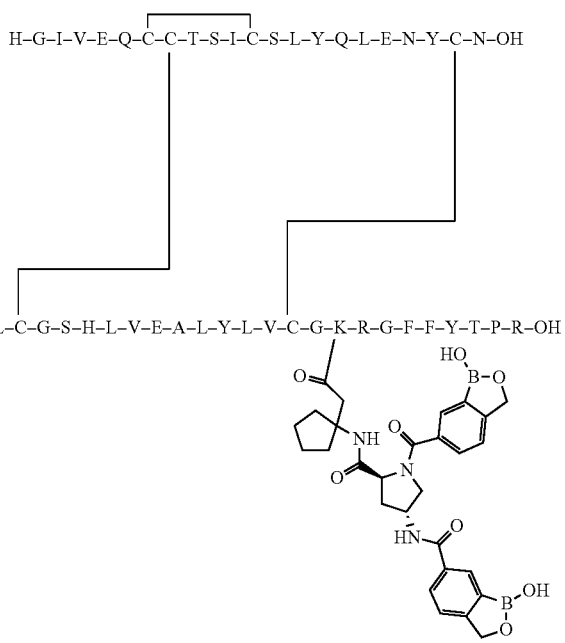
Example 69 (SEQ ID NOS 25530 and 25531, respectively, in order of appearance):
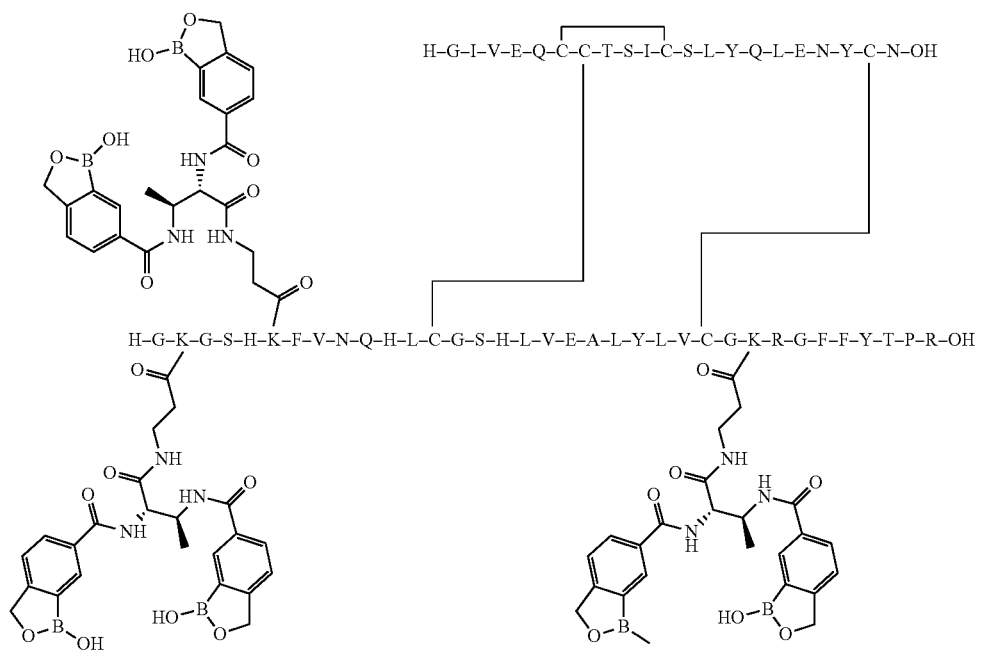 [SMILES: CC(=O)CCNC(=O)[C@@H](NC(=O)c1ccc2c(c1)B(O)OC2)[C@H](C)NC(=O)c1ccc2c(c1)B(O)OC2 ; CC(=O)CCNC(=O)[C@@H](NC(=O)c1ccc2c(c1)B(O)OC2)[C@H](C)NC(=O)c1ccc2c(c1)B(O)OC2 ; CB1OCc2ccc(C(=O)N[C@H](C(=O)NCCC(C)=O)[C@H](C)NC(=O)c3ccc4c(c3)B(O)OC4)cc21]
Example 70 (SEQ ID NOS 25532 and 25533, respectively, in order of appearance):

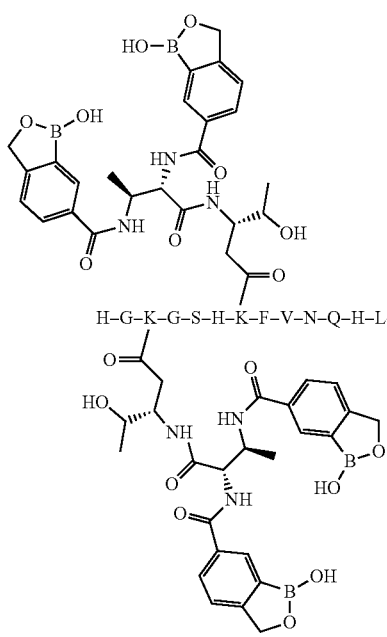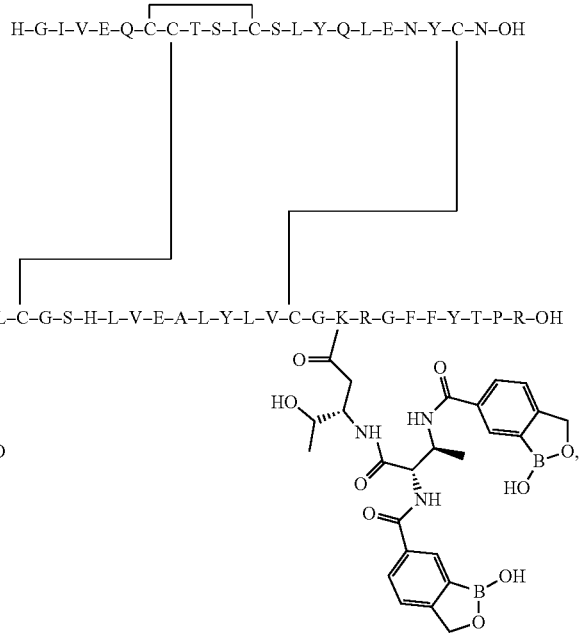
Example 71 (SEQ ID NOS 25534 and 25535, respectively, in order of appearance):
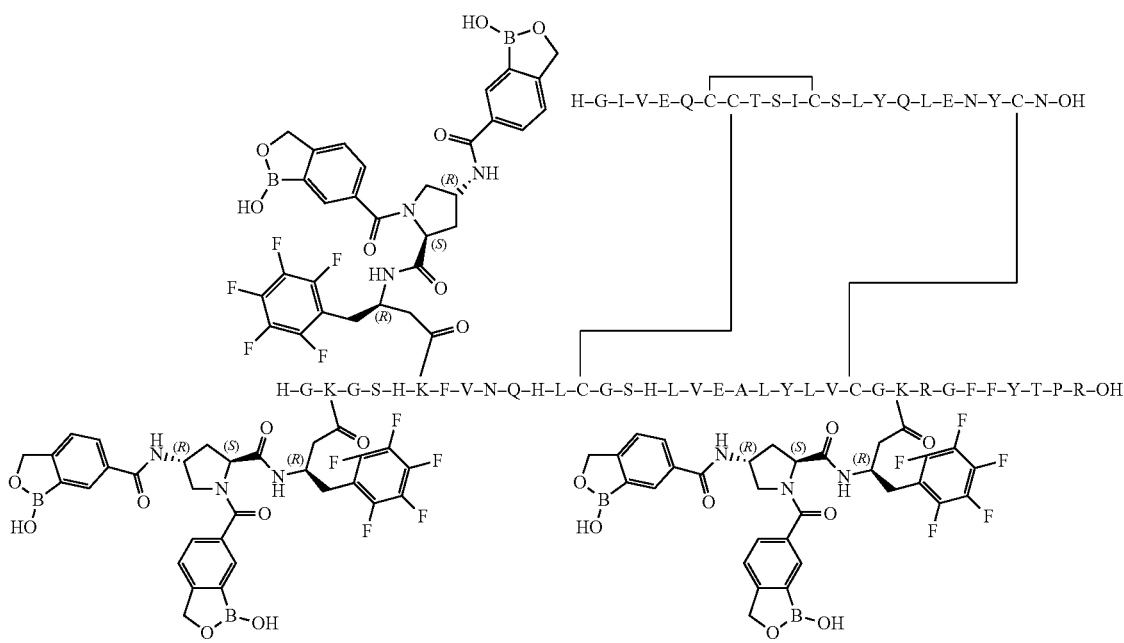
Example 72 (SEQ ID NOS 25536 and 25537, respectively, in order of appearance):

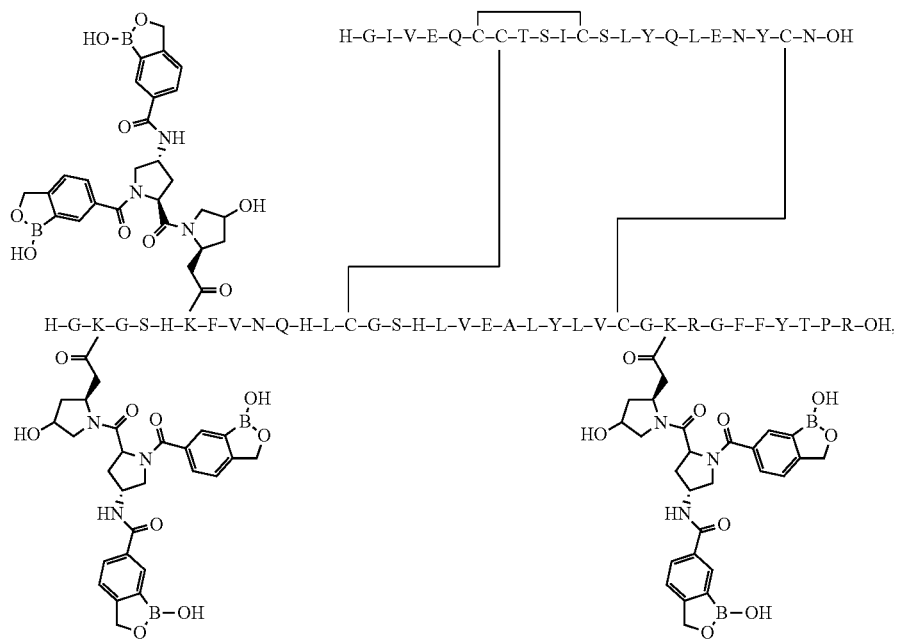 [SMILES: CC(=O)C[C@@H]1CC(O)CN1C(=O)[C@@H]1C[C@@H](NC(=O)c2ccc3c(c2)B(O)OC3)CN1C(=O)c1ccc2c(c1)B(O)OC2 ; CC(=O)C[C@@H]1CC(O)CN1C(=O)C1C[C@@H](NC(=O)c2ccc3c(c2)B(O)OC3)CN1C(=O)c1ccc2c(c1)B(O)OC2 ; CC(=O)C[C@@H]1CC(O)CN1C(=O)C1C[C@@H](NC(=O)c2ccc3c(c2)B(O)OC3)CN1C(=O)c1ccc2c(c1)B(O)OC2]
Example 73 (SEQ ID NOS 25538 and 25539, respectively, in order of appearance):
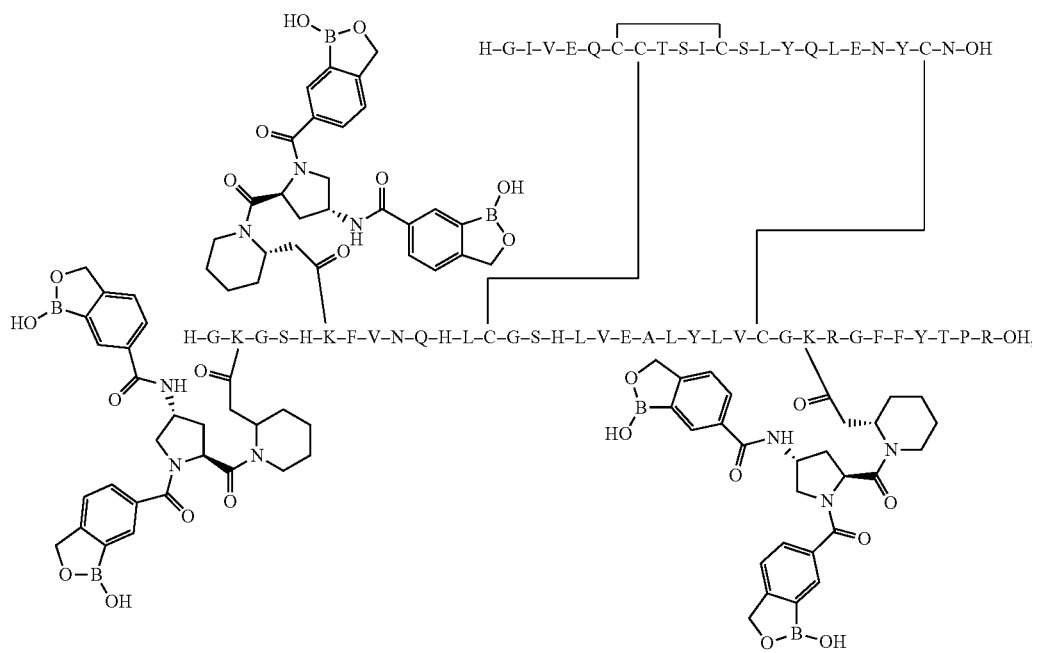 [SMILES: CC(=O)CC1CCCCN1C(=O)[C@@H]1C[C@@H](NC(=O)c2ccc3c(c2)B(O)OC3)CN1C(=O)c1ccc2c(c1)B(O)OC2 ; CC(=O)C[C@@H]1CCCCN1C(=O)[C@@H]1C[C@@H](NC(=O)c2ccc3c(c2)B(O)OC3)CN1C(=O)c1ccc2c(c1)B(O)OC2 ; CC(=O)C[C@@H]1CCCCN1C(=O)[C@@H]1C[C@@H](NC(=O)c2ccc3c(c2)B(O)OC3)CN1C(=O)c1ccc2c(c1)B(O)OC2]
Example 74 (SEQ ID NOS 25540 and 25541, respectively, in order of appearance):

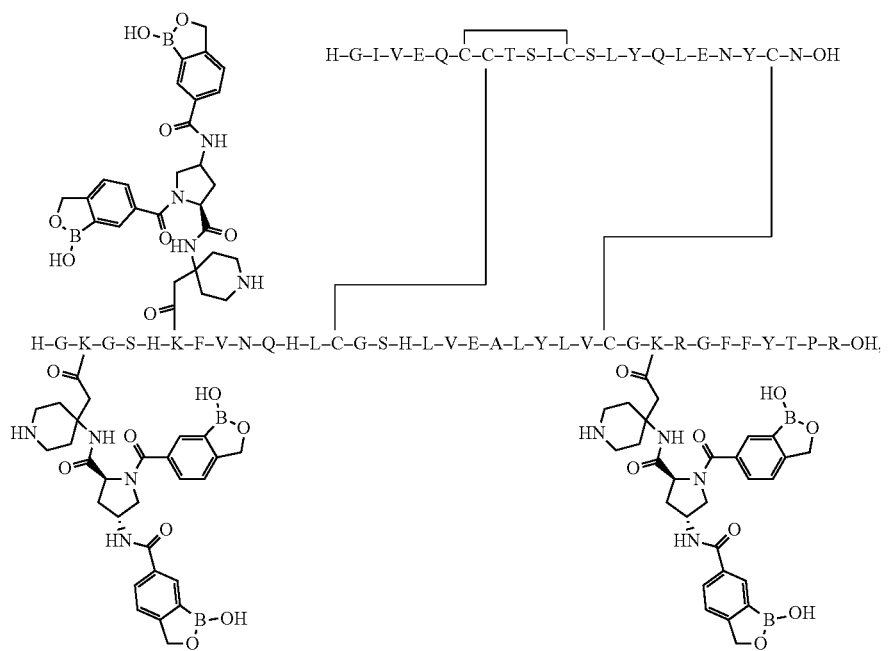 [SMILES: CC(=O)CC1(NC(=O)[C@@H]2CC(NC(=O)c3ccc4c(c3)B(O)OC4)CN2C(=O)c2ccc3c(c2)B(O)OC3)CCNCC1 ; CC(=O)CC1(NC(=O)[C@@H]2C[C@@H](NC(=O)c3ccc4c(c3)B(O)OC4)CN2C(=O)c2ccc3c(c2)B(O)OC3)CCNCC1 ; CC(=O)CC1(NC(=O)[C@@H]2C[C@@H](NC(=O)c3ccc4c(c3)B(O)OC4)CN2C(=O)c2ccc3c(c2)B(O)OC3)CCNCC1]
Example 75 (SEQ ID NOS 25542 and 25543, respectively, in order of appearance):
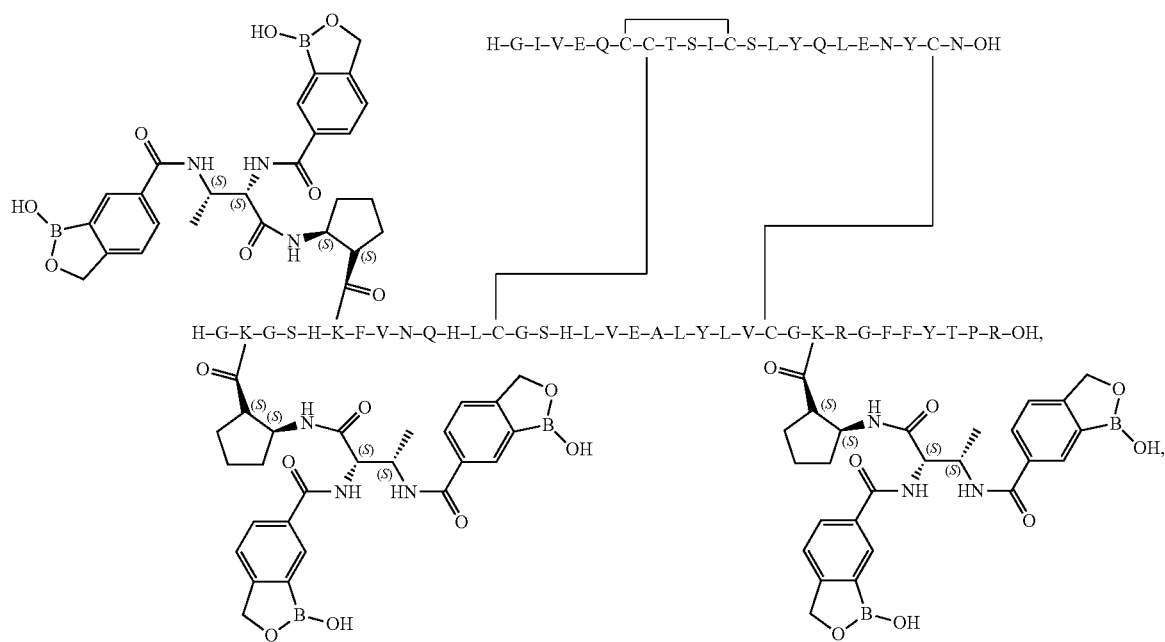
Example 76 (SEQ ID NOS 25544 and 25545, respectively, in order of appearance):

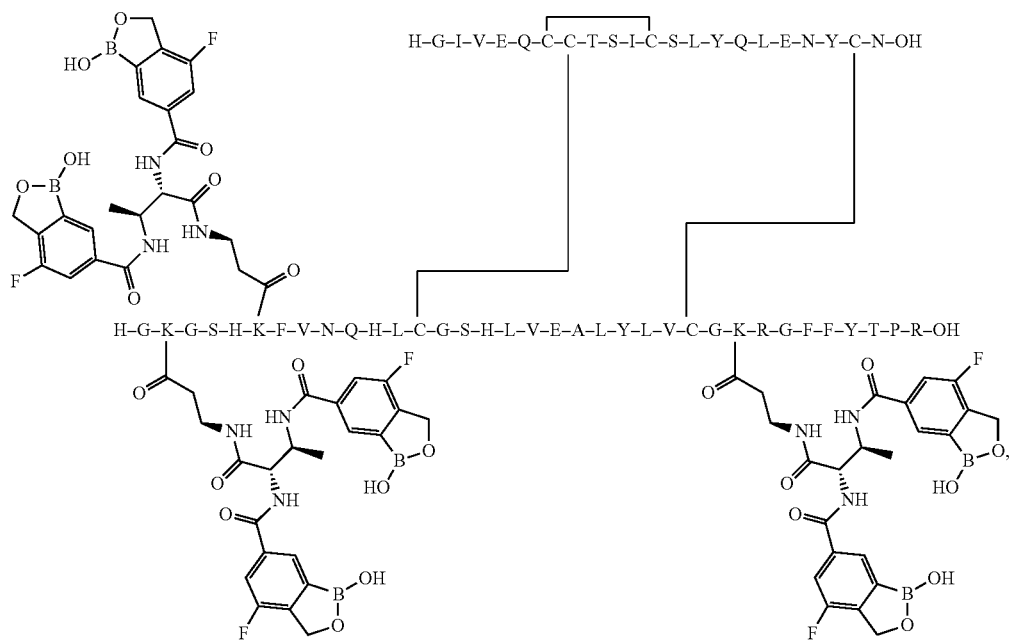
Example 77 (SEQ ID NOS 25546 and 25547, respectively, in order of appearance):
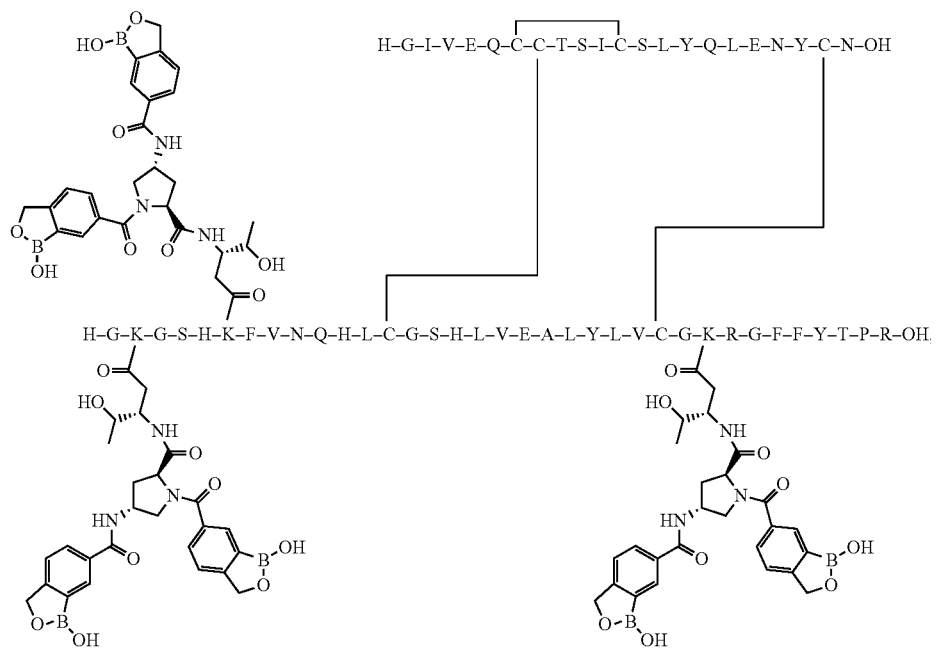 [SMILES: CC(=O)C[C@H](NC(=O)[C@@H]1C[C@@H](NC(=O)c2ccc3c(c2)B(O)OC3)CN1C(=O)c1ccc2c(c1)B(O)OC2)C(C)O ; CC(=O)C[C@H](NC(=O)[C@@H]1C[C@@H](NC(=O)c2ccc3c(c2)B(O)OC3)CN1C(=O)c1ccc2c(c1)B(O)OC2)C(C)O ; CC(=O)C[C@H](NC(=O)[C@@H]1C[C@@H](NC(=O)c2ccc3c(c2)B(O)OC3)CN1C(=O)c1ccc2c(c1)B(O)OC2)C(C)O]
Example 78 (SEQ ID NOS 25548 and 25549, respectively, in order of appearance):

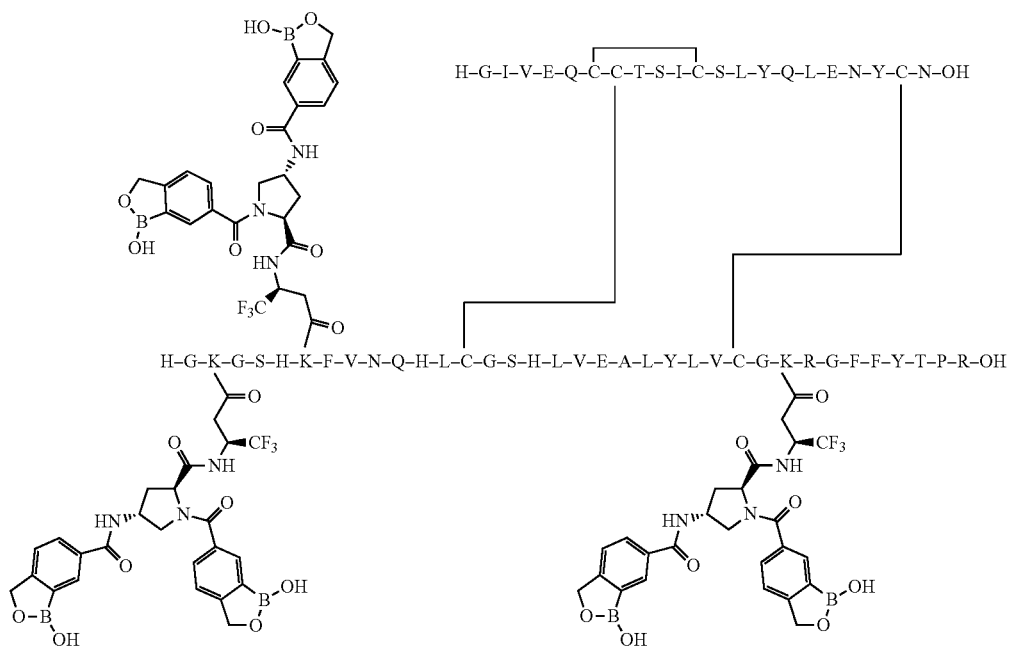 [SMILES: CC(=O)C[C@H](NC(=O)[C@@H]1C[C@@H](NC(=O)c2ccc3c(c2)B(O)OC3)CN1C(=O)c1ccc2c(c1)B(O)OC2)C(F)(F)F ; CC(=O)C[C@H](NC(=O)[C@@H]1C[C@@H](NC(=O)c2ccc3c(c2)B(O)OC3)CN1C(=O)c1ccc2c(c1)B(O)OC2)C(F)(F)F ; CC(=O)C[C@H](NC(=O)[C@@H]1C[C@@H](NC(=O)c2ccc3c(c2)B(O)OC3)CN1C(=O)c1ccc2c(c1)B(O)OC2)C(F)(F)F]
Example 79 (SEQ ID NOS 25550 and 25551, respectively, in order of appearance):
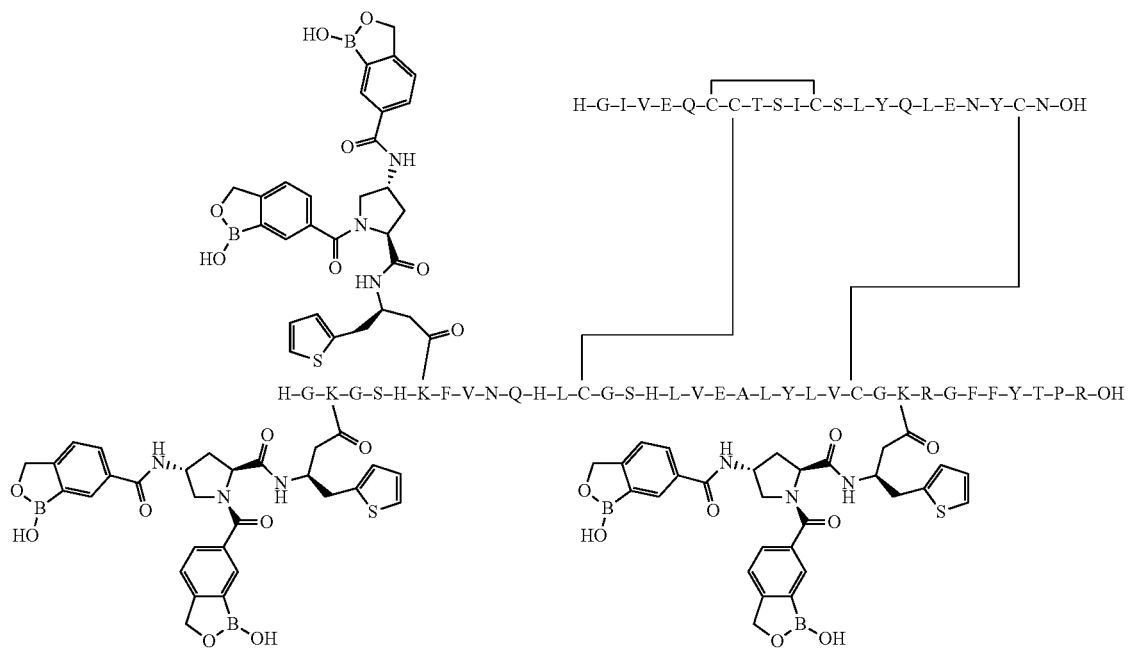
Example 80 (SEQ ID NOS 25552 and 25553, respectively, in order of appearance):

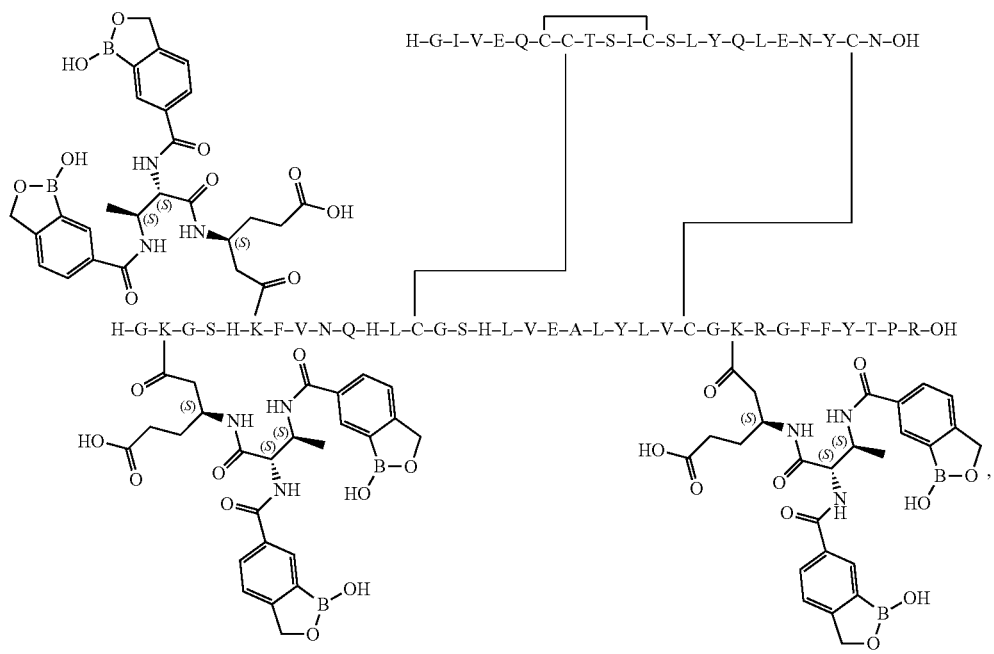
Example 81 (SEQ ID NOS 25554 and 25555, respectively, in order of appearance):
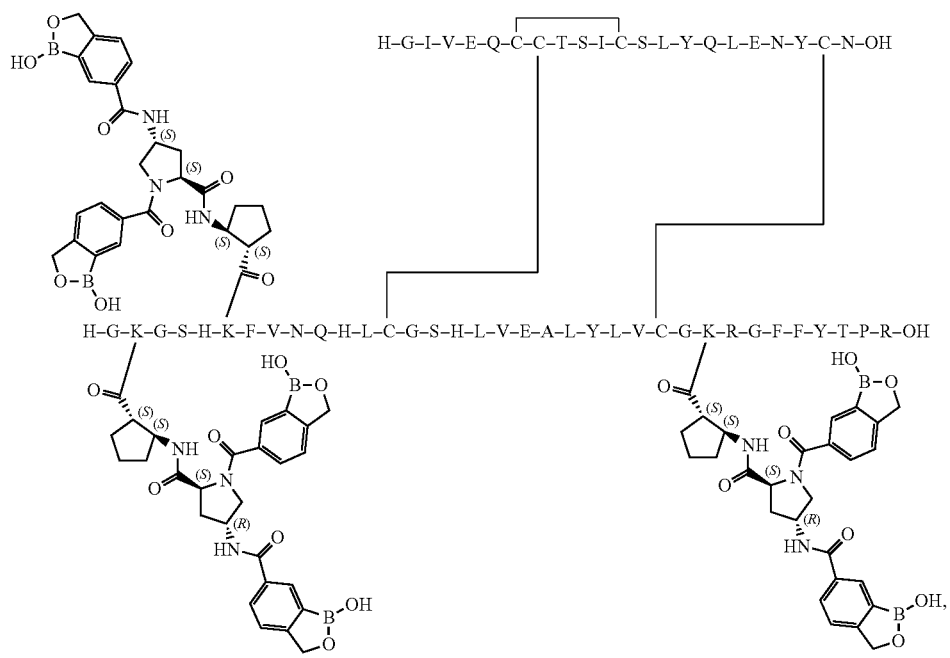
Example 82 (SEQ ID NOS 25556 and 25557, respectively, in order of appearance):

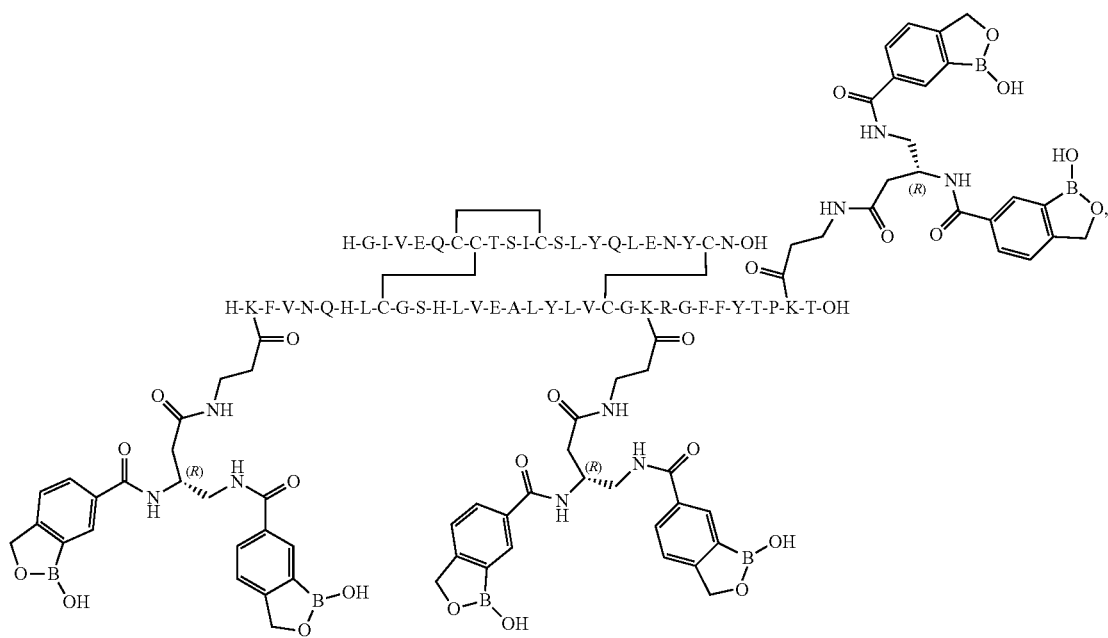
Example 83 (SEQ ID NOS 25558 and 25559, respectively, in order of appearance):
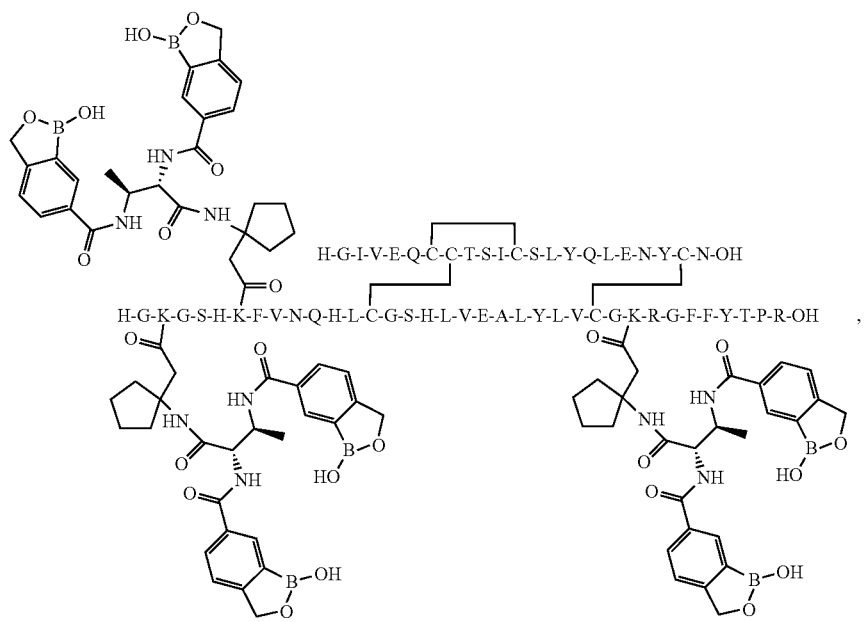
Example 84 (SEQ ID NOS 25560 and 25561, respectively, in order of appearance):

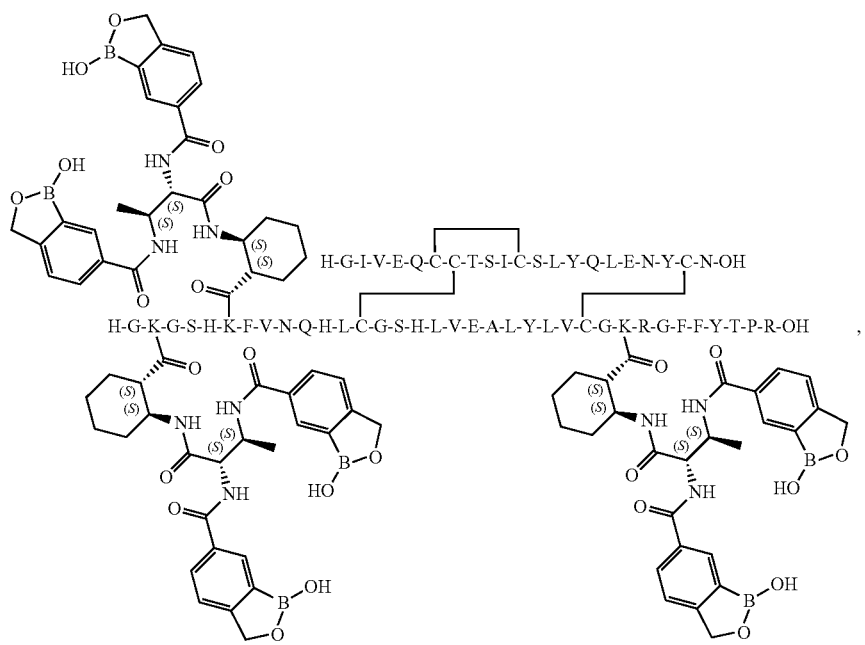
Example 85 (SEQ ID NOS 25562 and 25563, respectively, in order of appearance):
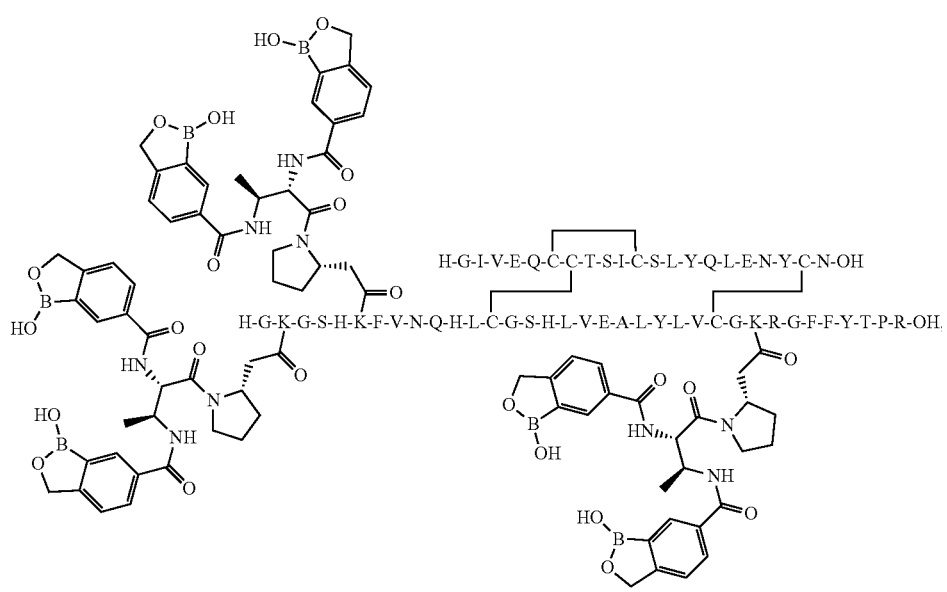
Example 86 (SEQ ID NOS 25564 and 25565, respectively, in order of appearance):

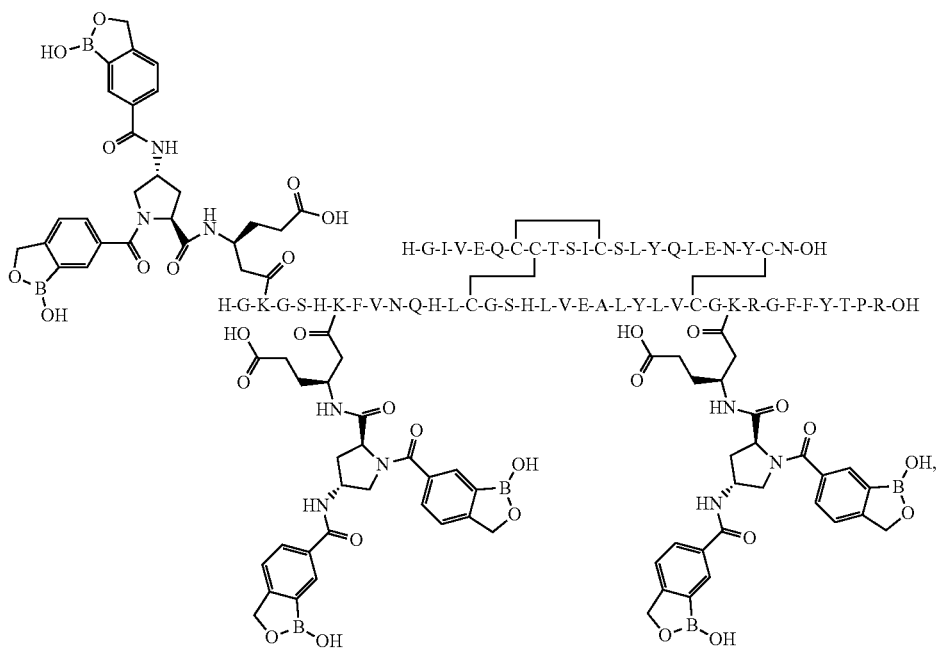
Example 87 (SEQ ID NOS 25566 and 25567, respectively, in order of appearance):
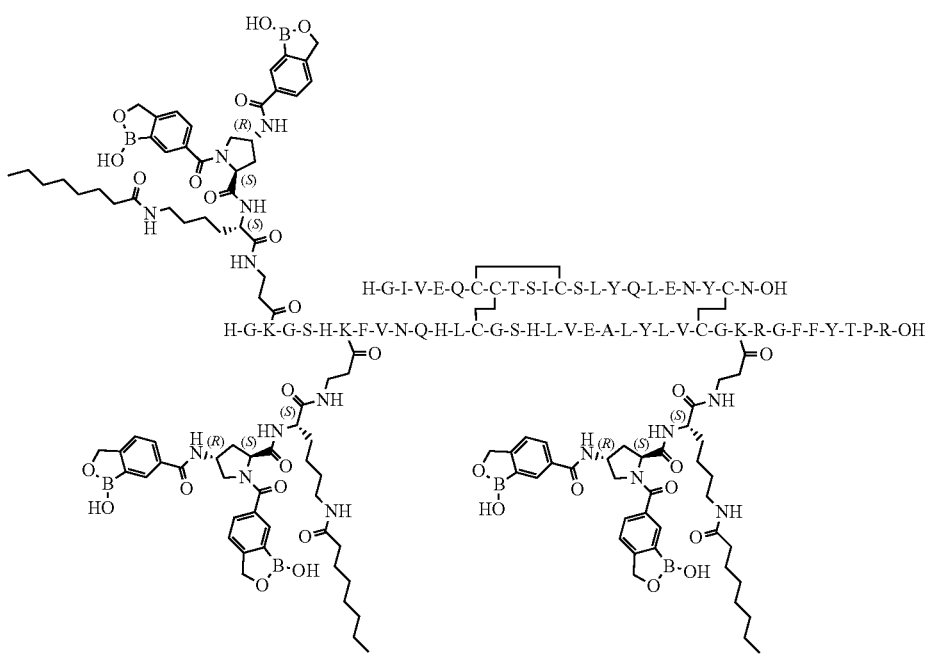
Example 88 (SEQ ID NOS 25568 and 25569, respectively, in order of appearance):

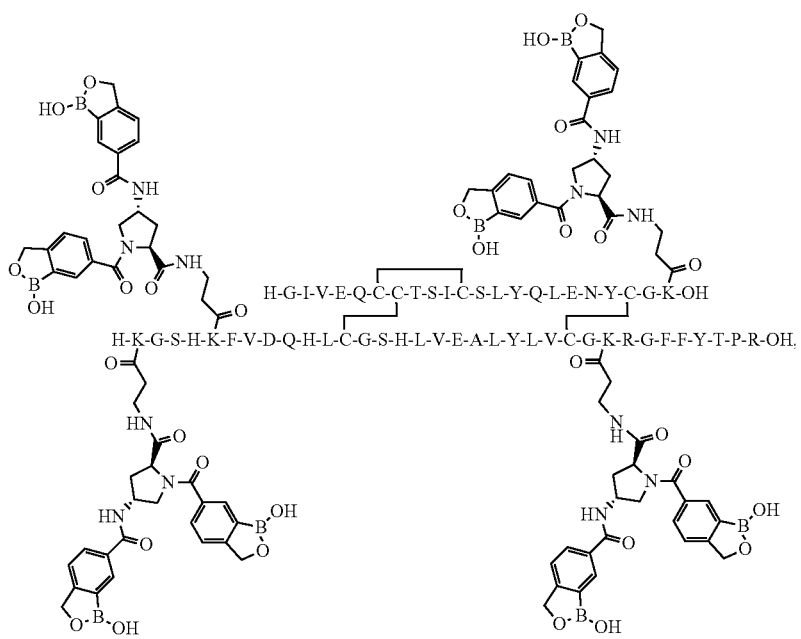
Example 89 (SEQ ID NOS 25570 and 25571, respectively, in order of appearance):
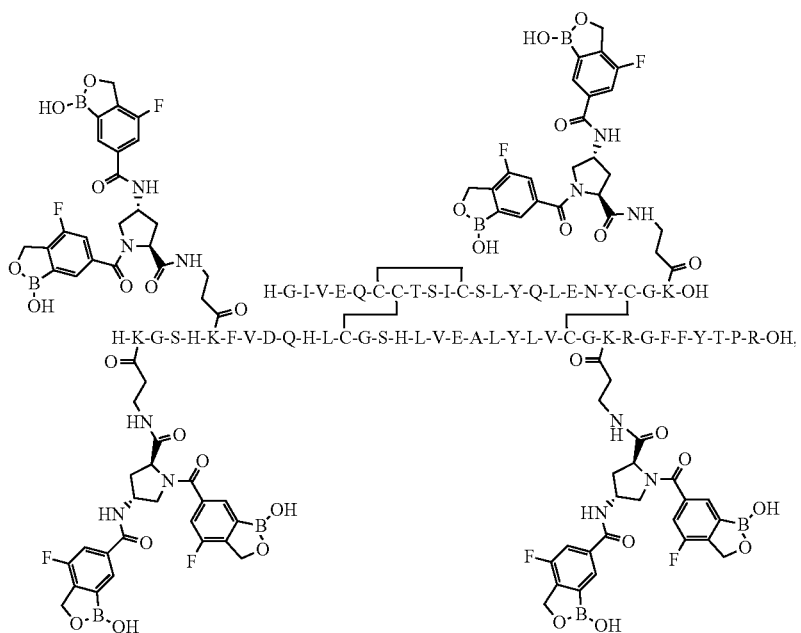
Example 90 (SEQ ID NOS 25572 and 25573, respectively, in order of appearance):

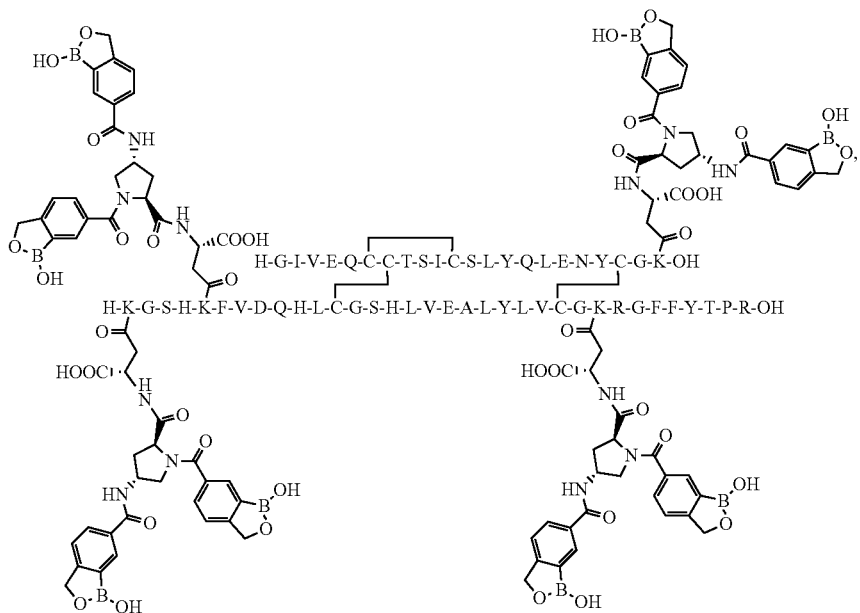
Example 91 (SEQ ID NOS 25574 and 25575, respectively, in order of appearance):
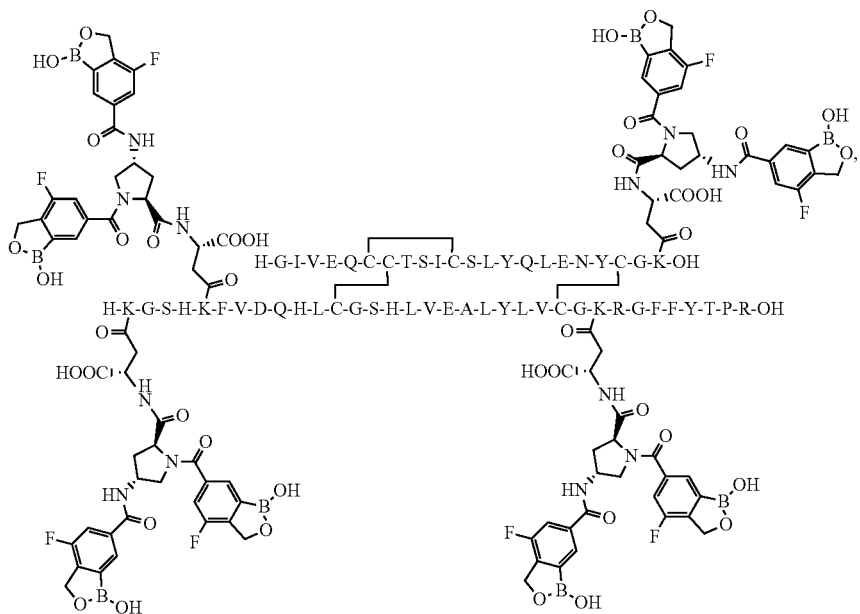
Example 92 (SEQ ID NOS 25576 and 25577, respectively, in order of appearance):

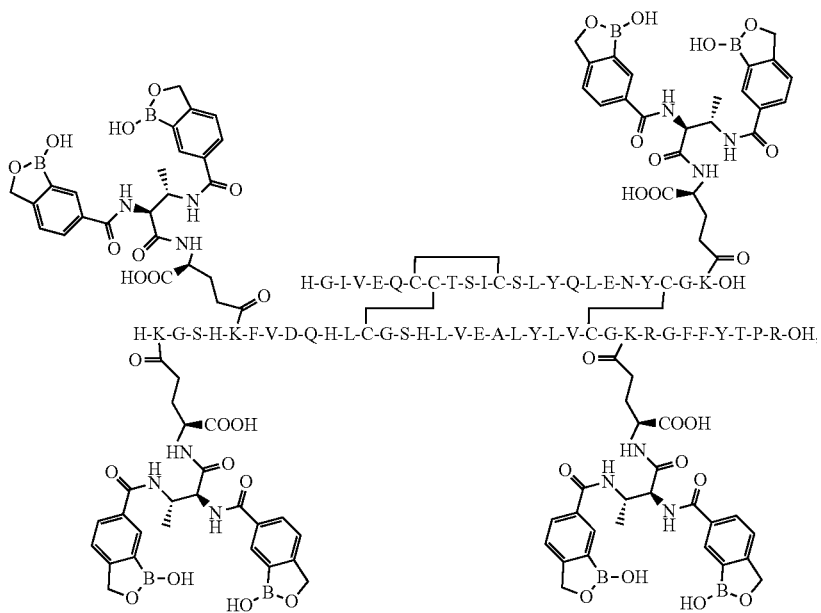
Example 93 (SEQ ID NOS 25578 and 25579, respectively, in order of appearance):
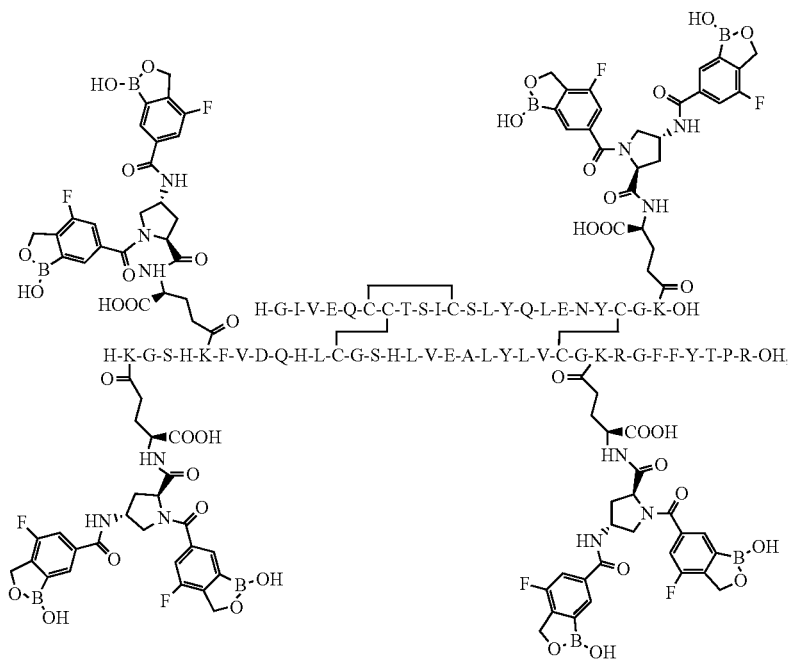
Example 94 (SEQ ID NOS 25580 and 25581, respectively, in order of appearance):

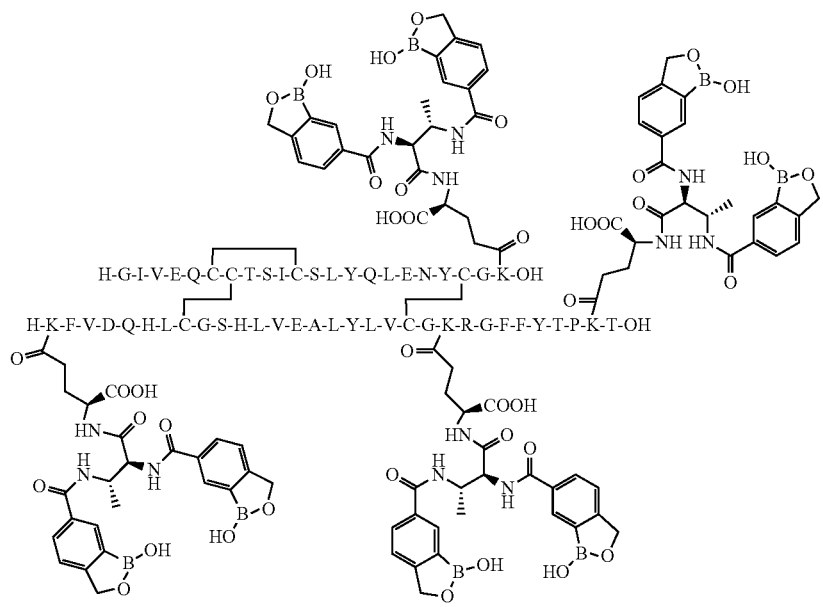
Example 95 (SEQ ID NOS 25582 and 25583, respectively, in order of appearance):
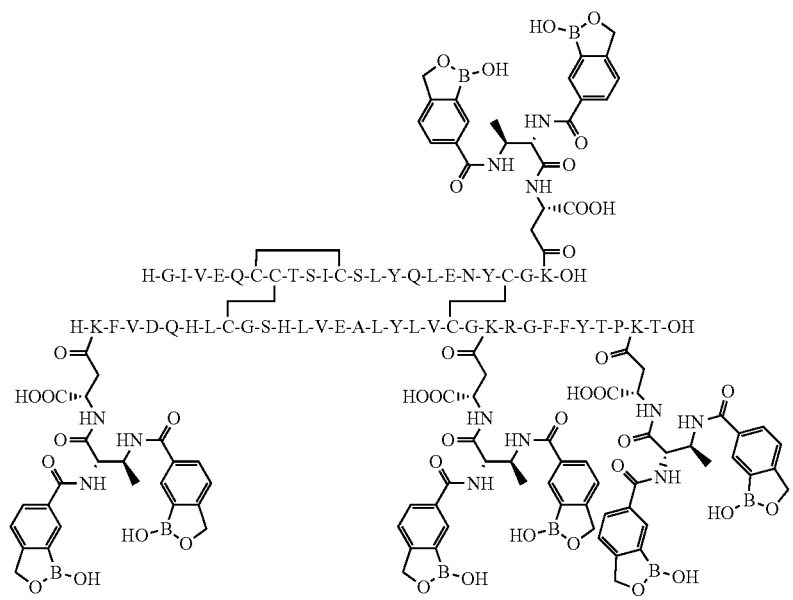
Example 96 (SEQ ID NOS 25584 and 25585, respectively, in order of appearance):

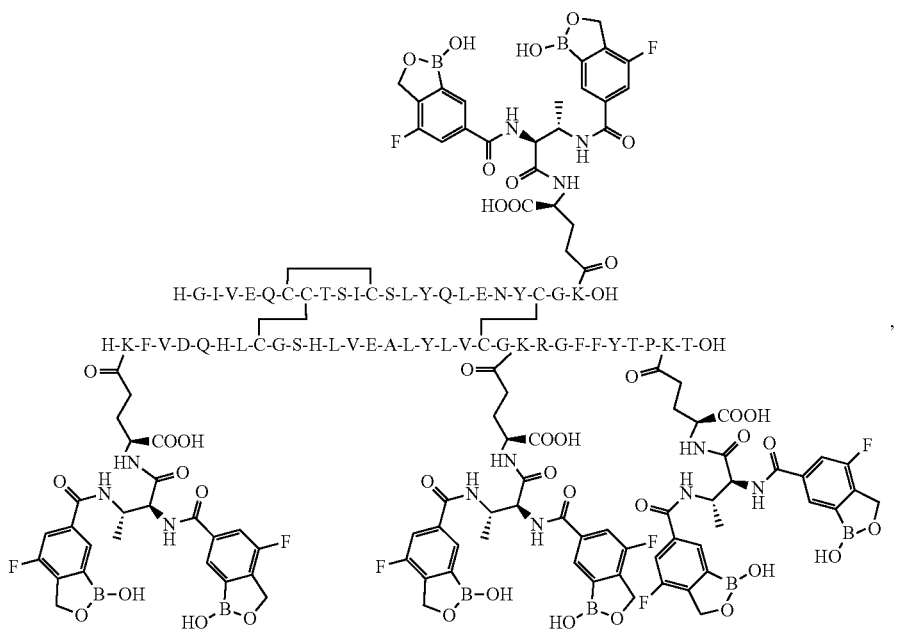
Example 97 (SEQ ID NOS 25586 and 25587, respectively, in order of appearance):
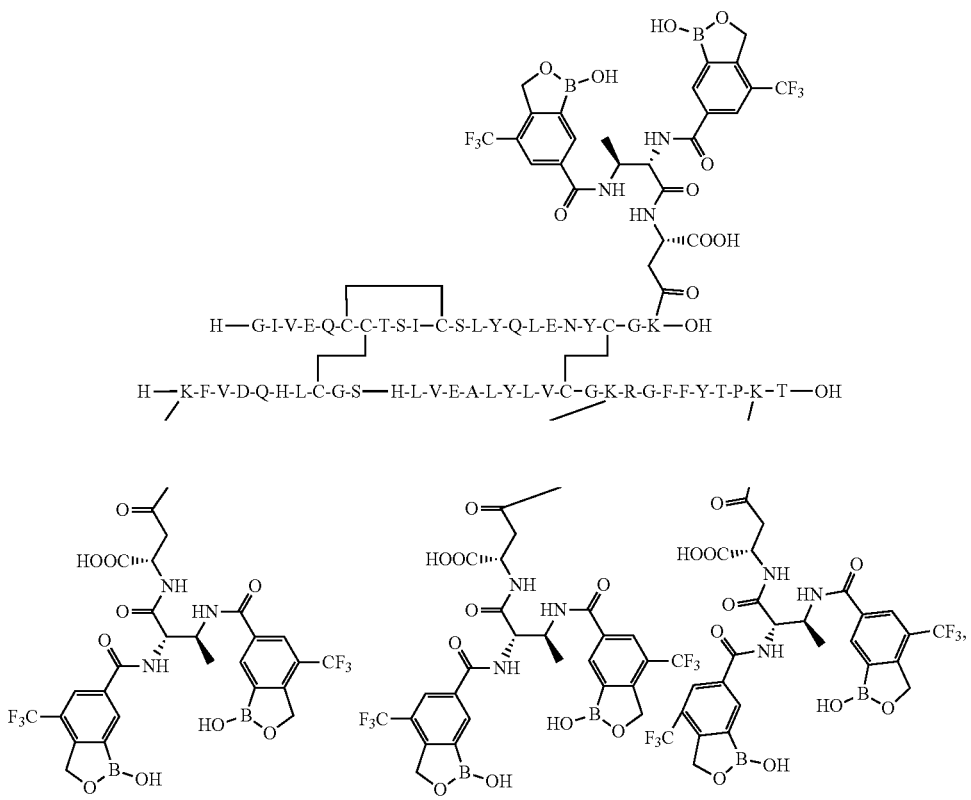
Example 98 (SEQ ID NOS 25588 and 25589, respectively, in order of appearance):

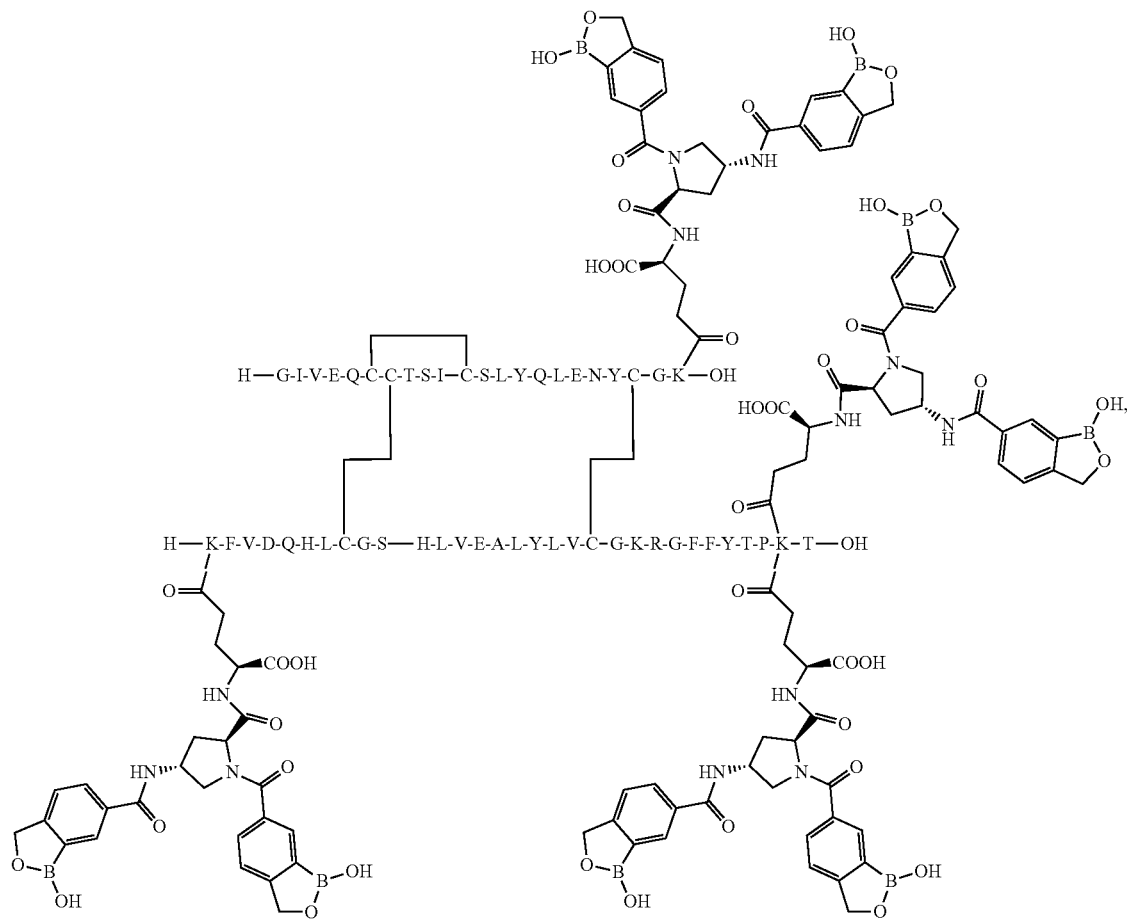
Example 99 (SEQ ID NOS 25590 and 25591, respectively, in order of appearance):
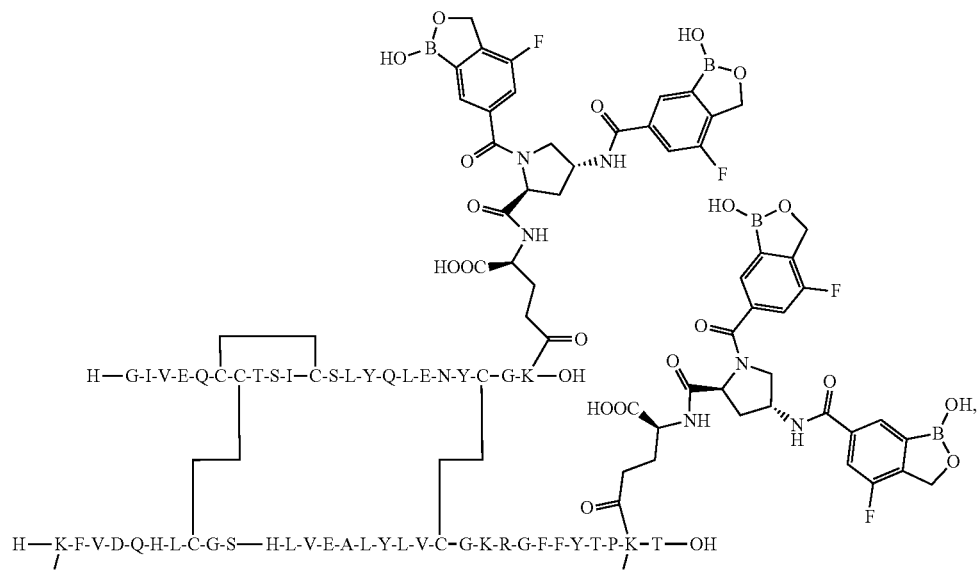

219 220
-continued
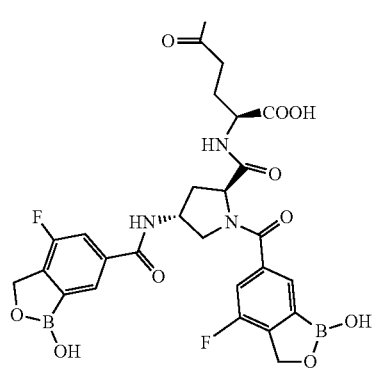
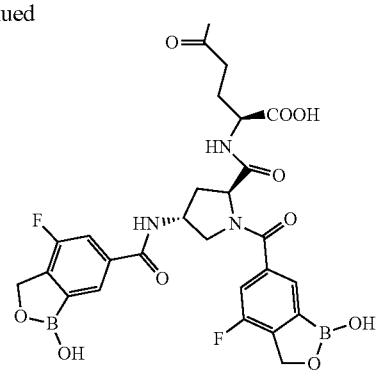
Example 100 (SEQ ID NOS 25592 and 25593, respectively, in order of appearance):
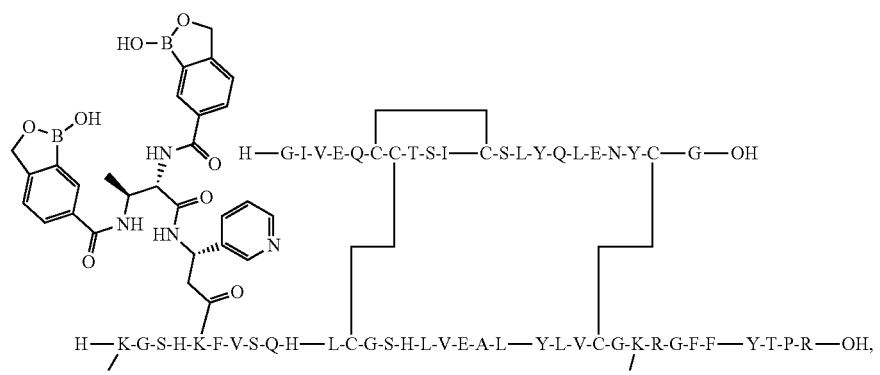
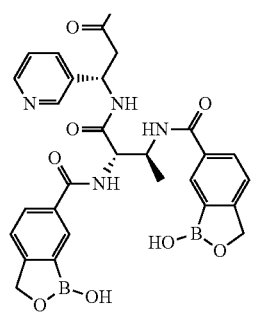
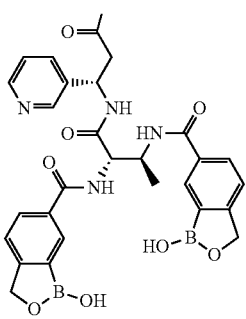
Example 101 (SEQ ID NOS 25594 and 25595, respectively, in order of appearance):

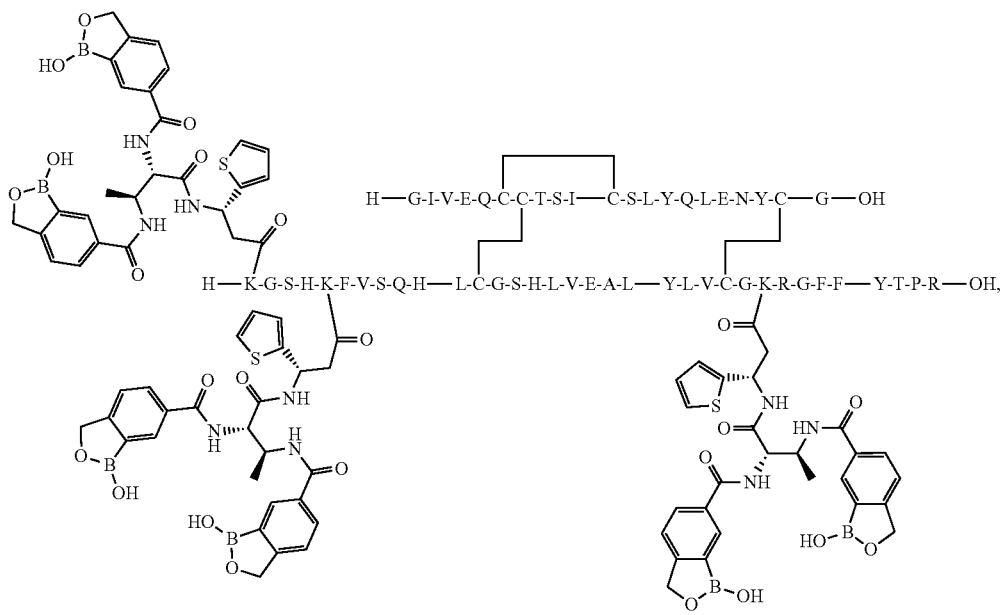
Example 102 (SEQ ID NOS 25596 and 25597, respectively, in order of appearance):
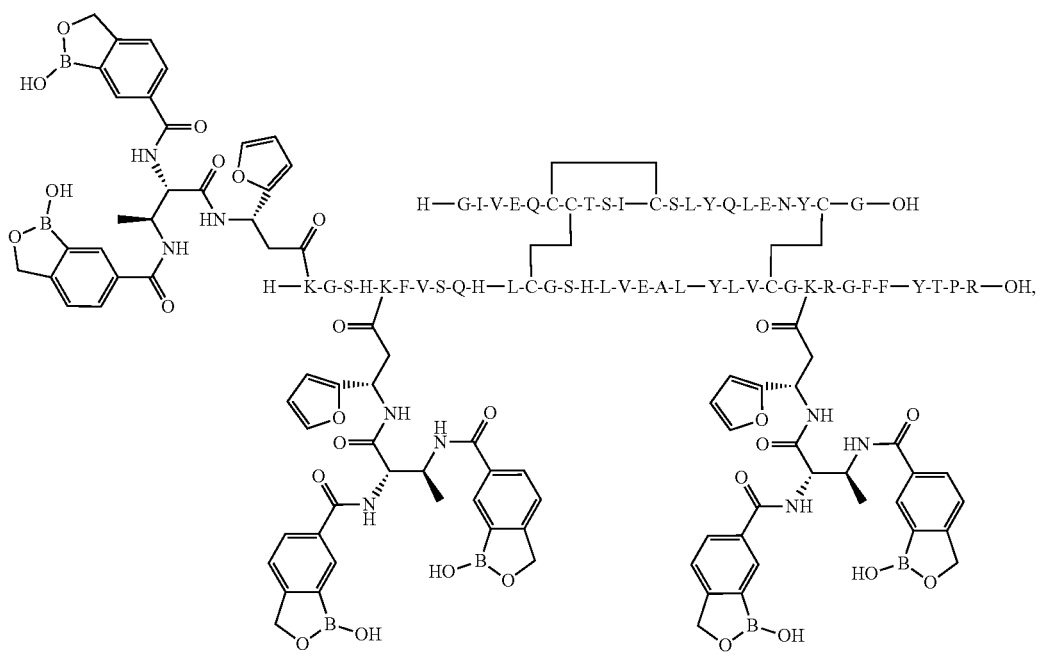
Example 103 (SEQ ID NOS 25598 and 25599, respectively, in order of appearance):

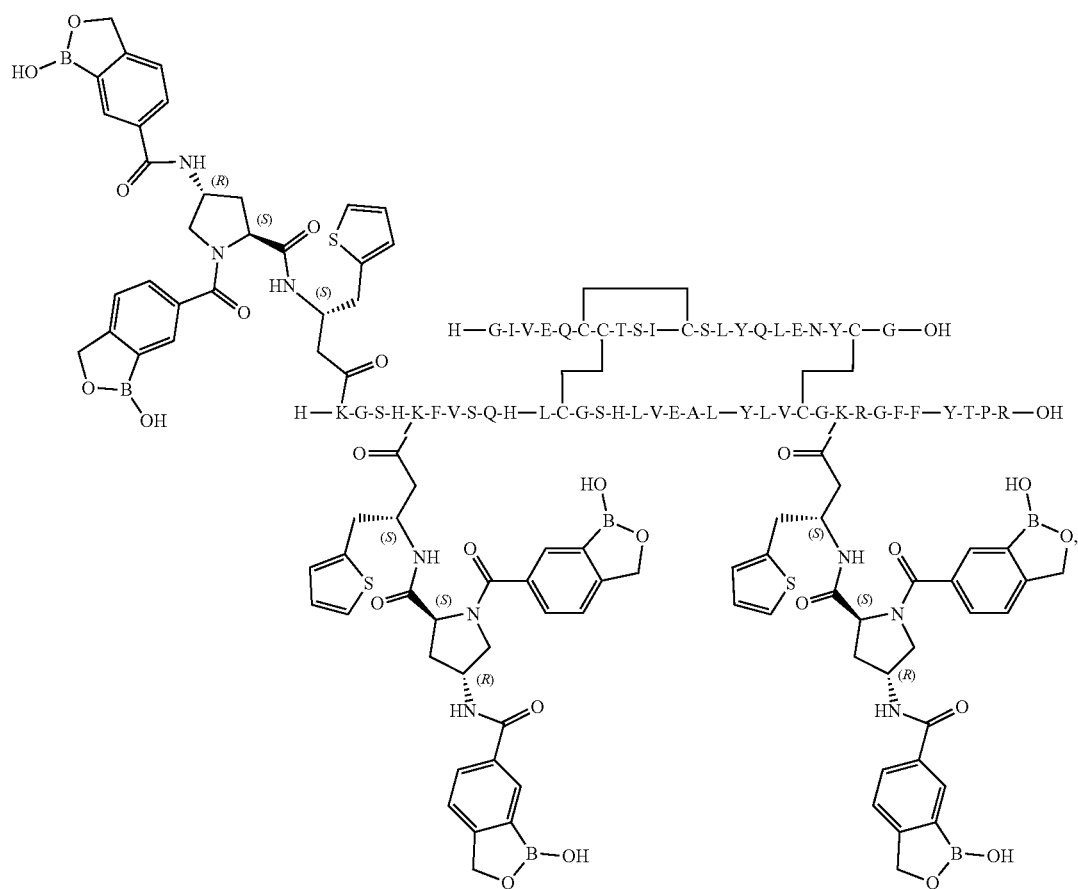
Example 104 (SEQ ID NOS 25600 and 25601, respectively, in order of appearance):
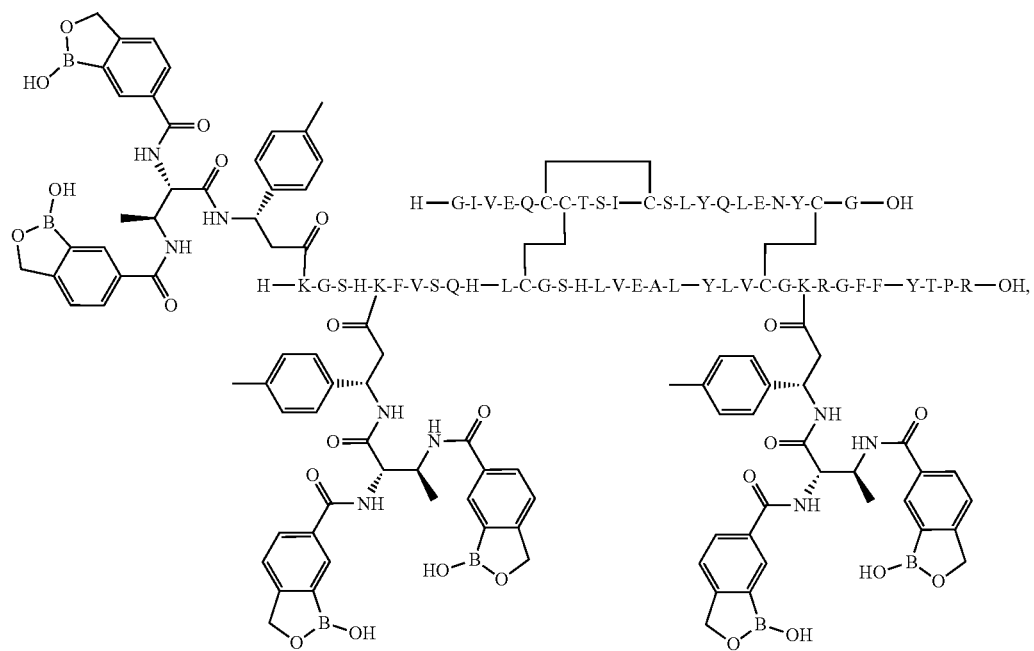

Example 105 (SEQ ID NOS 25602 and 25603, respectively, in order of appearance):
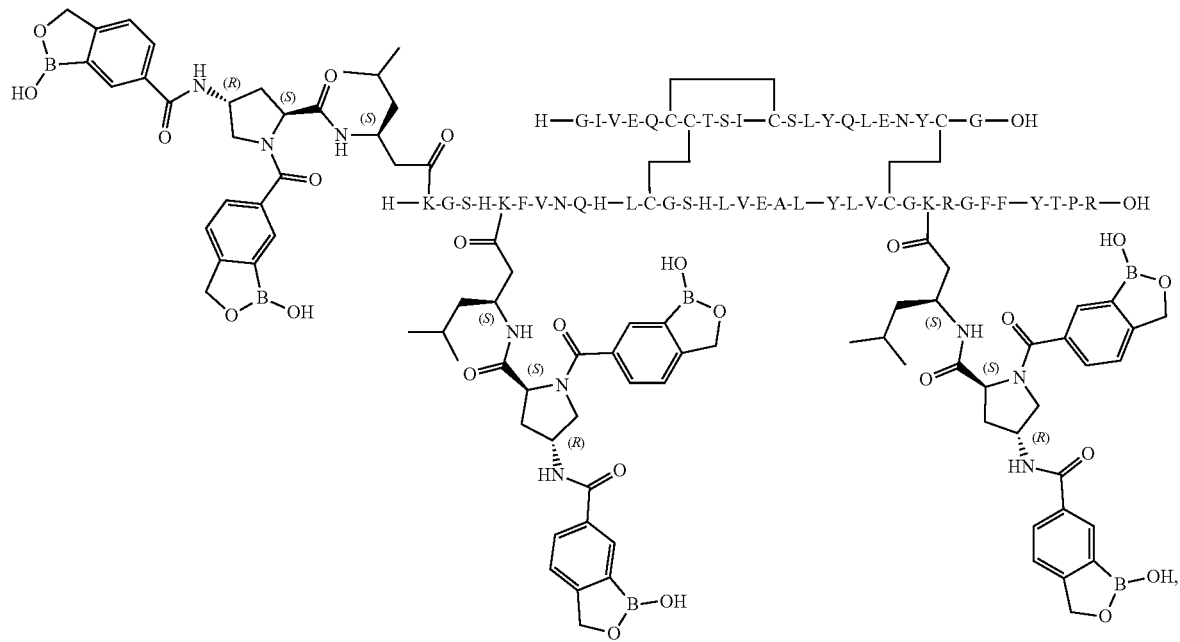
Example 106 (SEQ ID NOS 25604 and 25605, respectively, in order of appearance):
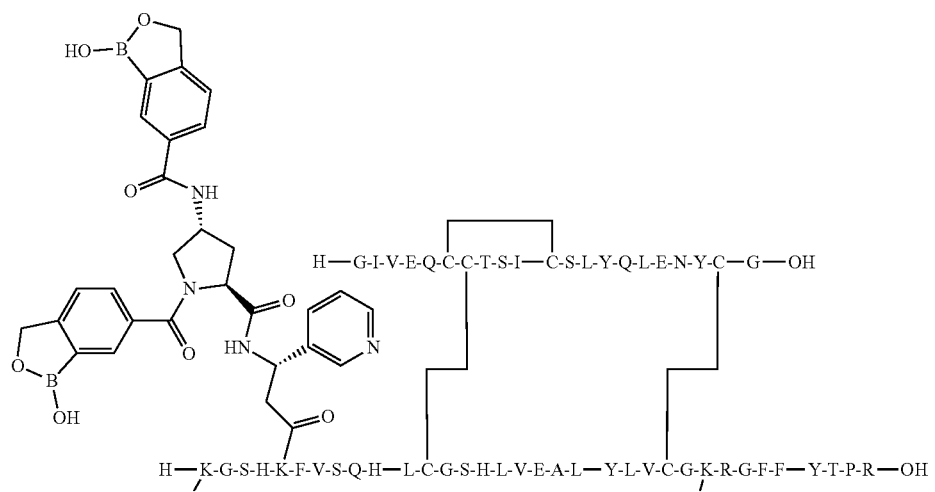

227
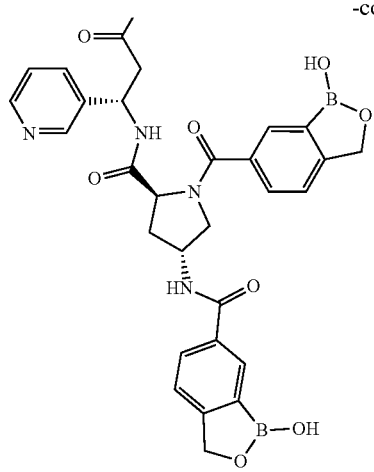
228
-continued
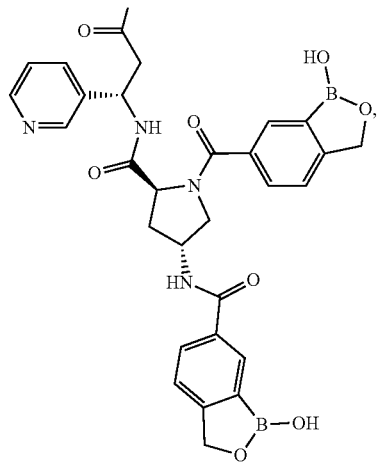
Example 107 (SEQ ID NOS 25606 and 25607, respectively, in order of appearance):
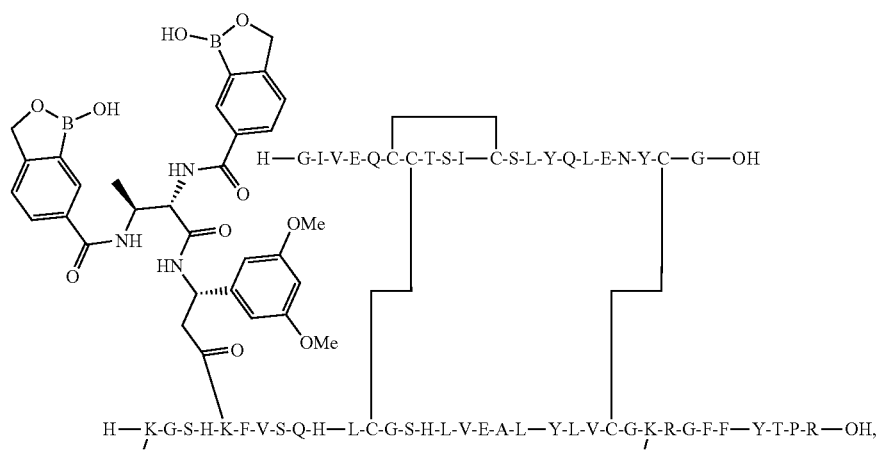
Example 108 (SEQ ID NOS 25608 and 25609, respectively, in order of appearance):
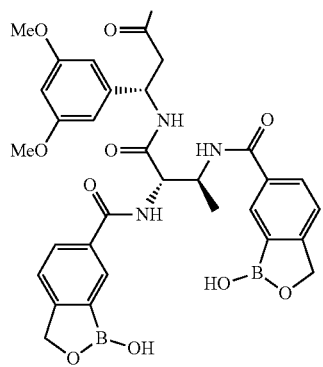
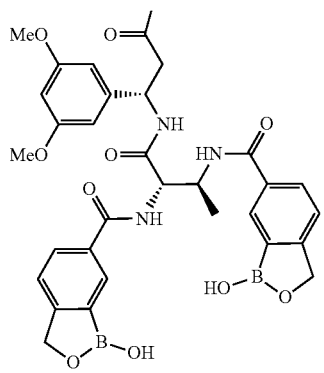

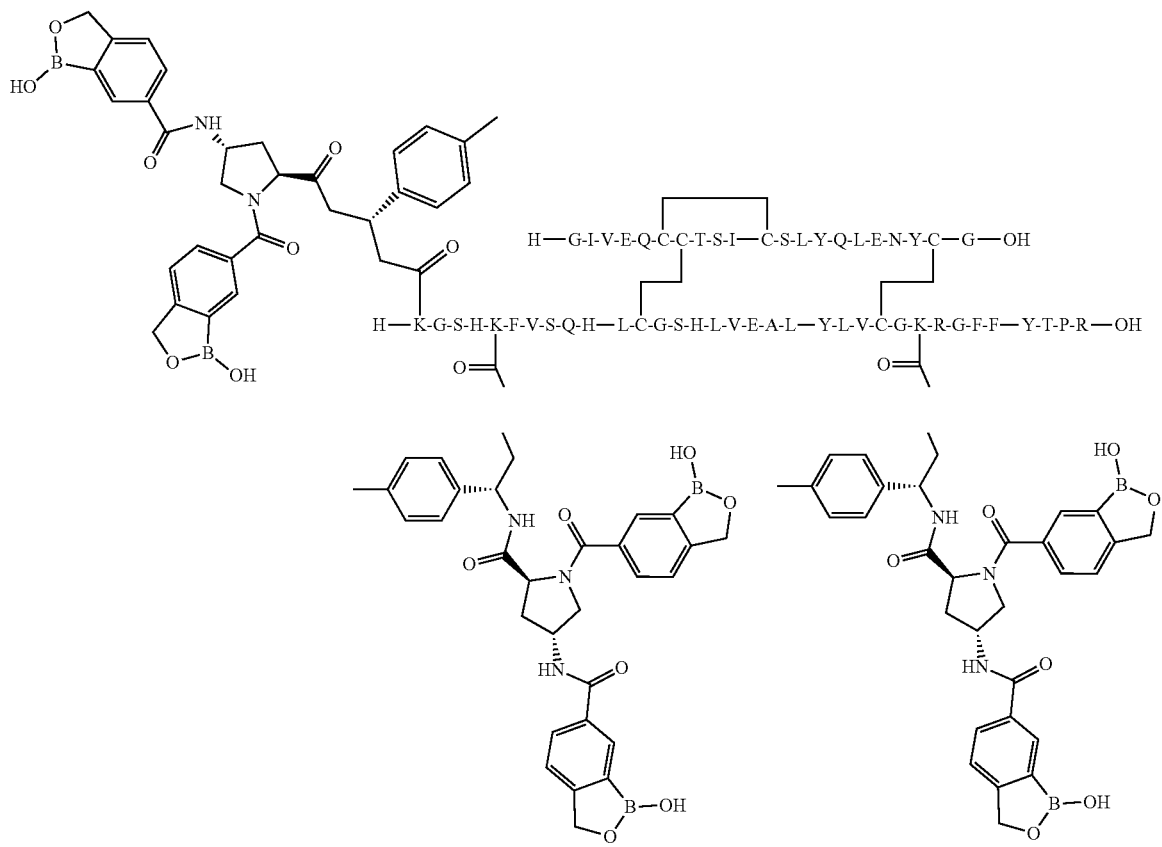
Example 109 (SEQ ID NOS 25610 and 25611, respectively, in order of appearance):
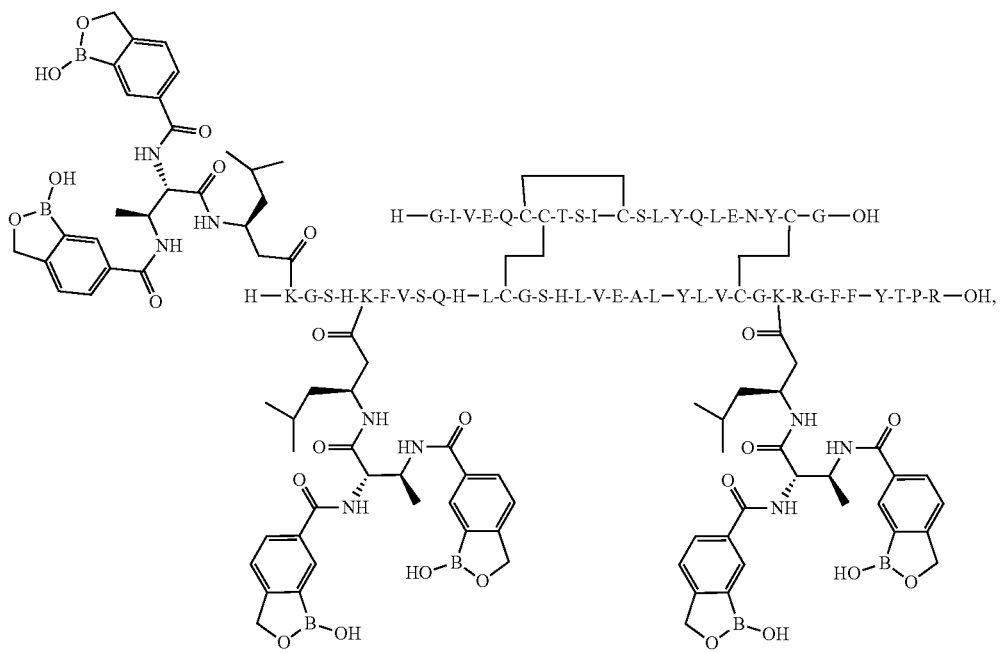
Example 110 (SEQ ID NOS 25612 and 25613, respectively, in order of appearance):

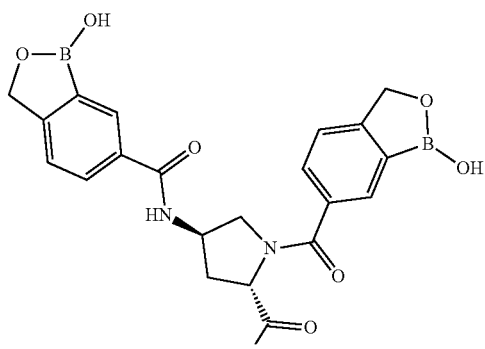
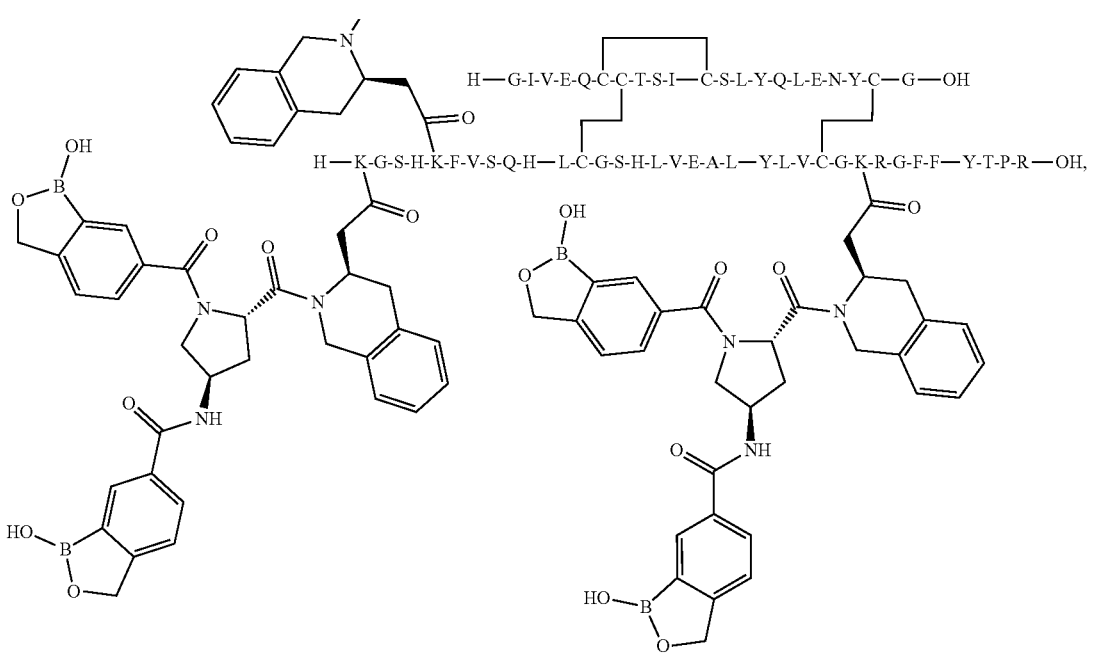
Example 111 (SEQ ID NOS 25614 and 25615, respectively, in order of appearance):
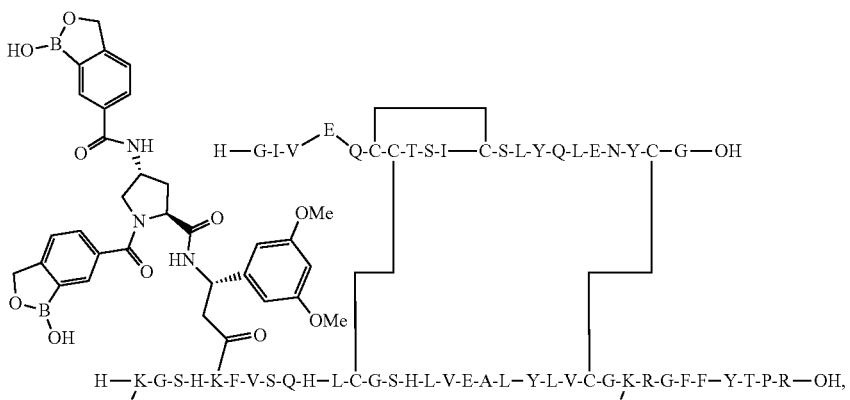

233 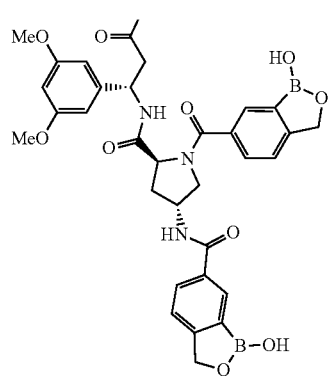 234 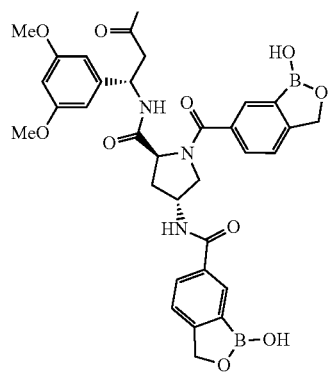
-continued
Example 112 (SEQ ID NOS 25616 and 25617, respectively, in order of appearance):
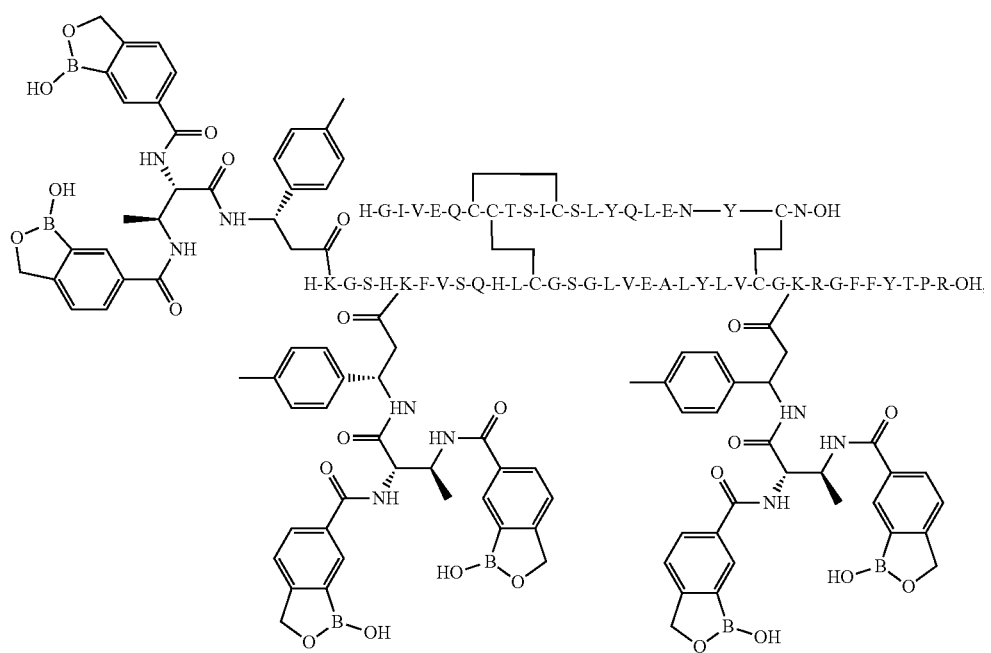
Example 113 (SEQ ID NOS 25618 and 25619, respectively, in order of appearance):

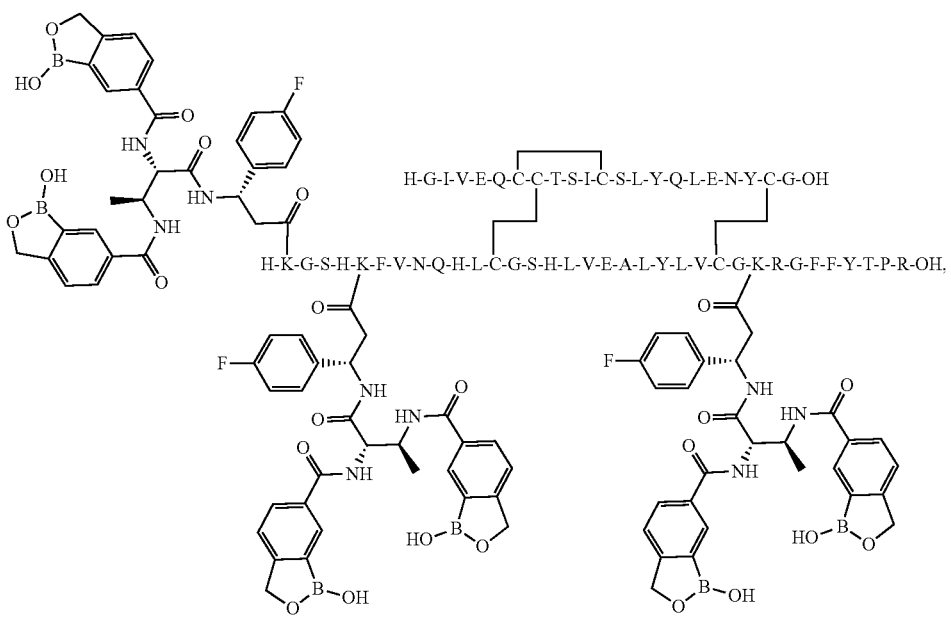
Example 114 (SEQ ID NOS 25620 and 25621, respectively, in order of appearance):
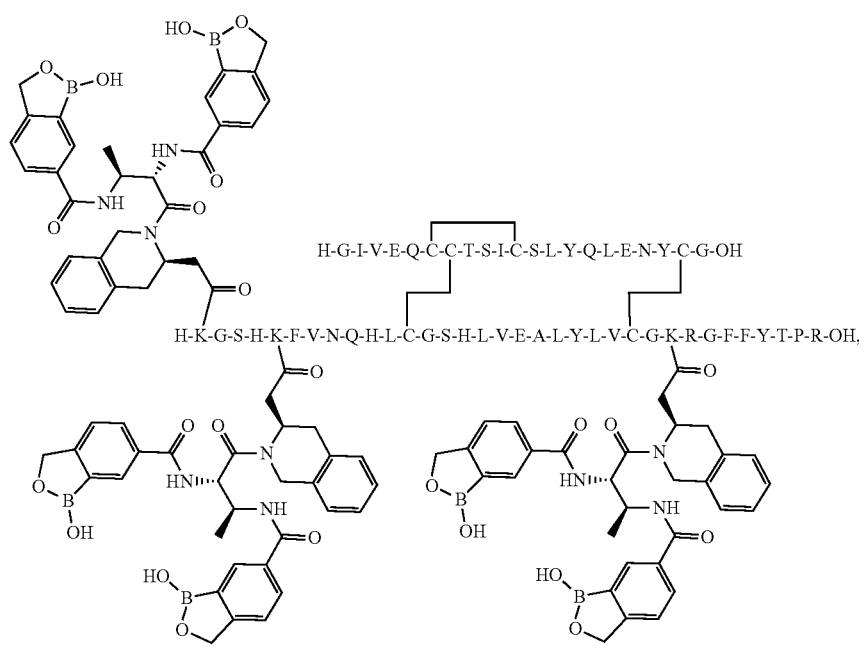
Example 115 (SEQ ID NOS 25622 and 25623, respectively, in order of appearance):

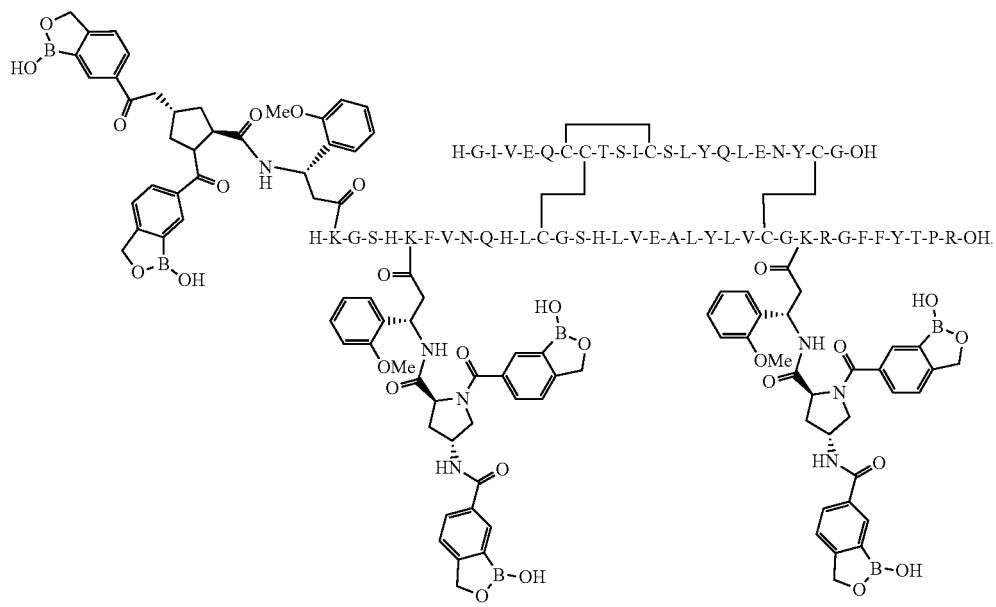
Example 116 (SEQ ID NOS 25624 and 25625, respectively, in order of appearance):
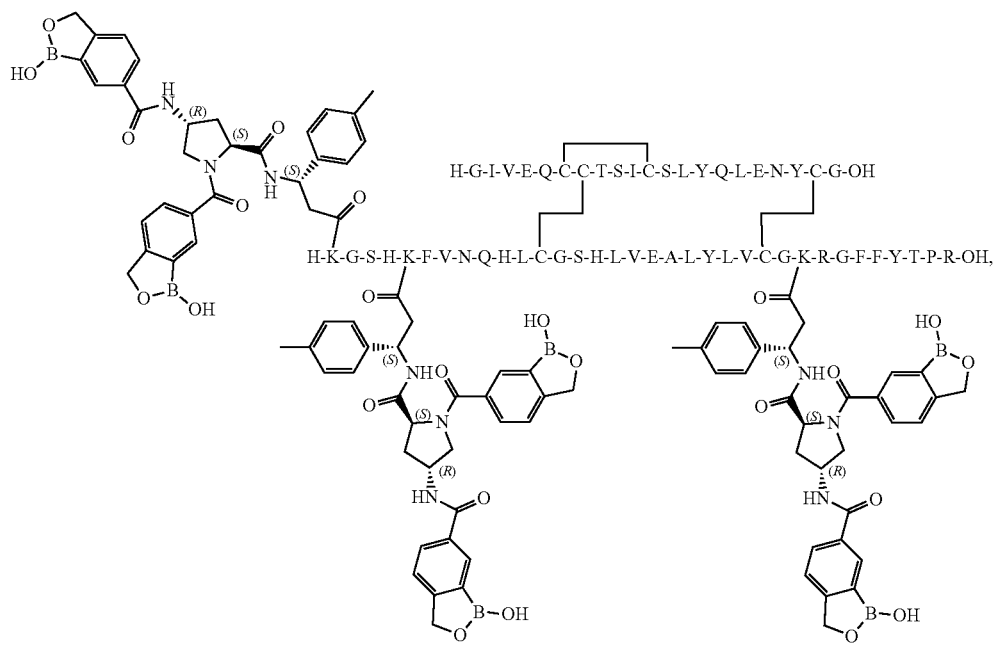
Example 117 (SEQ ID NOS 25626 and 25627, respectively, in order of appearance):

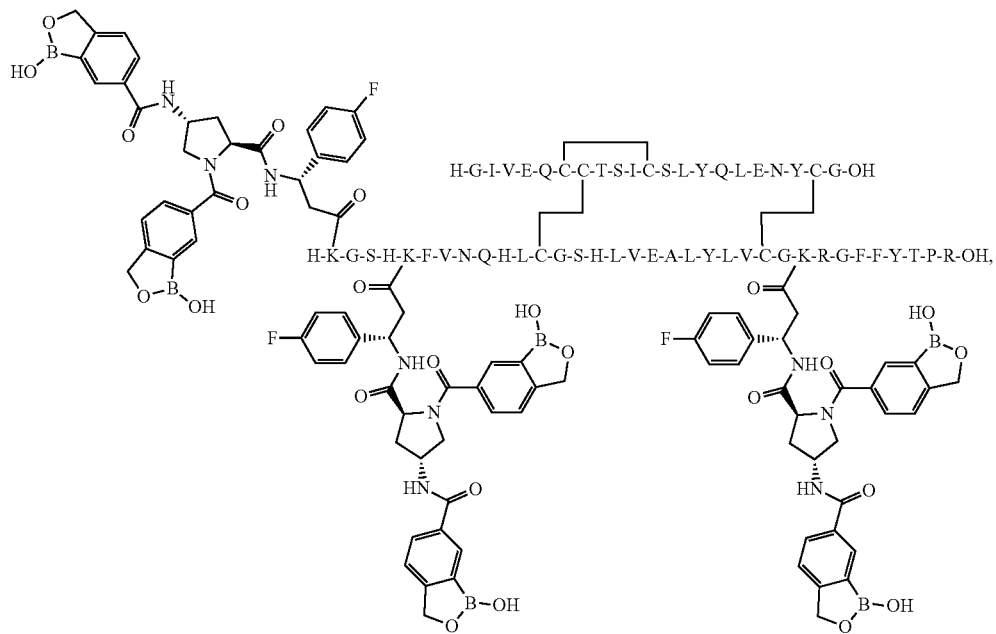
Example 118 (SEQ ID NOS 25628 and 25629, respectively, in order of appearance):
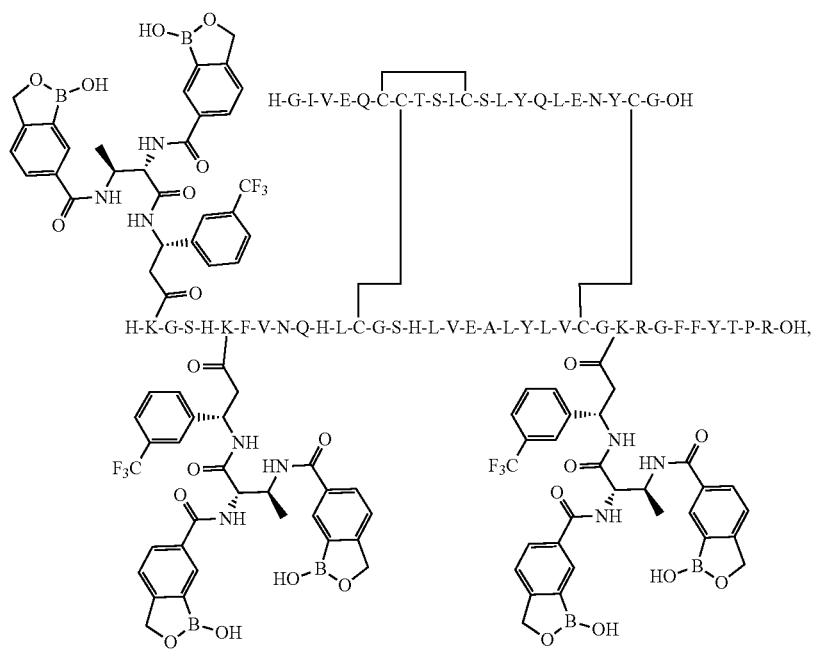
Example 119 (SEQ ID NOS 25630 and 25631, respectively, in order of appearance):

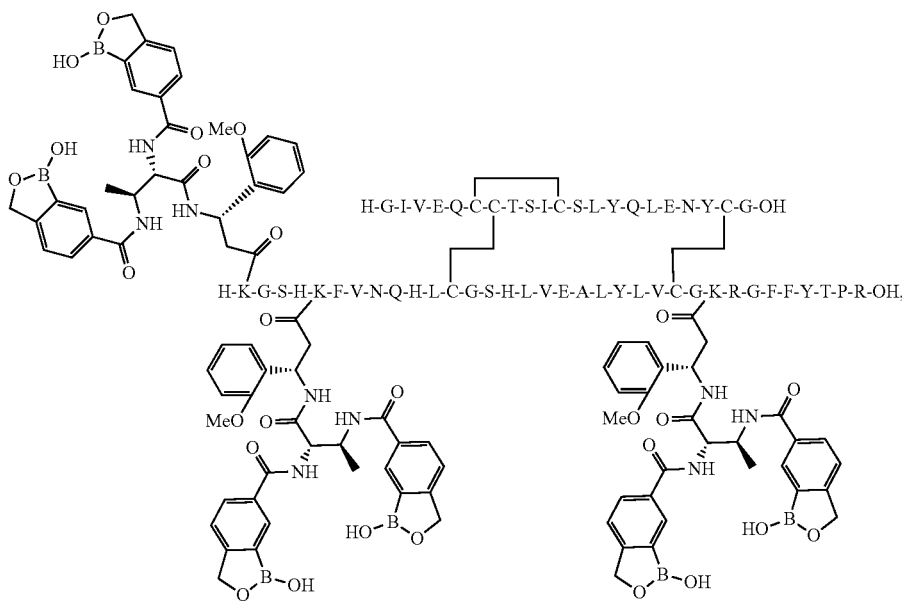
Example 120 (SEQ ID NOS 25632 and 25633, respectively, in order of appearance):
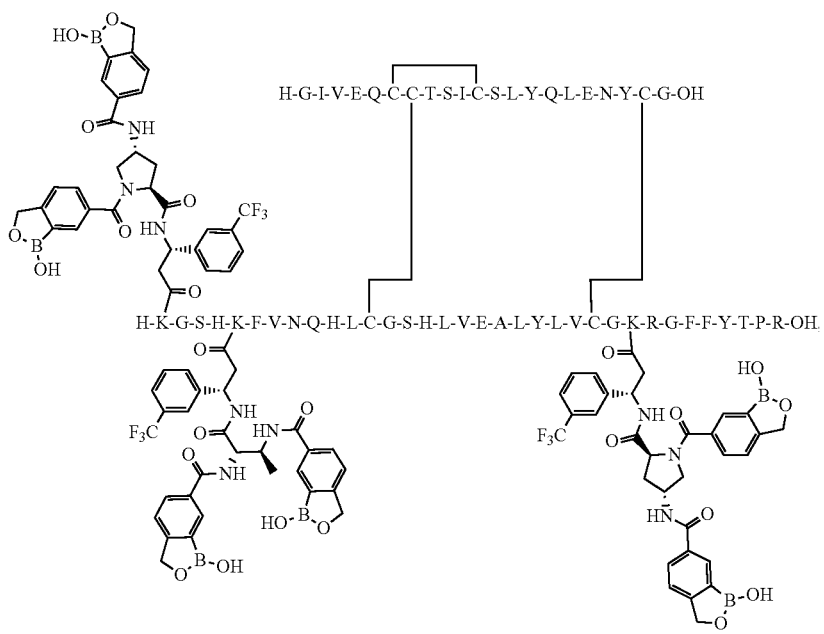
Example 121 (SEQ ID NOS 25634 and 25635, respectively, in order of appearance):

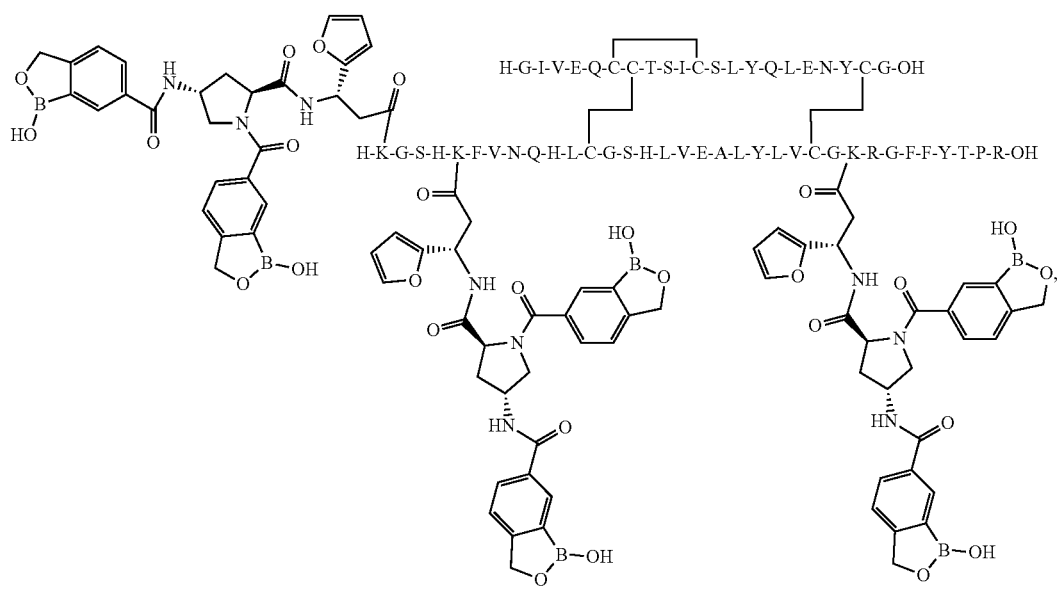
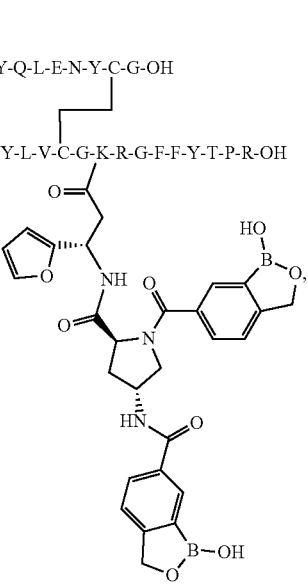
Example 122 (SEQ ID NOS 25636 and 25637, respectively, in order of appearance):
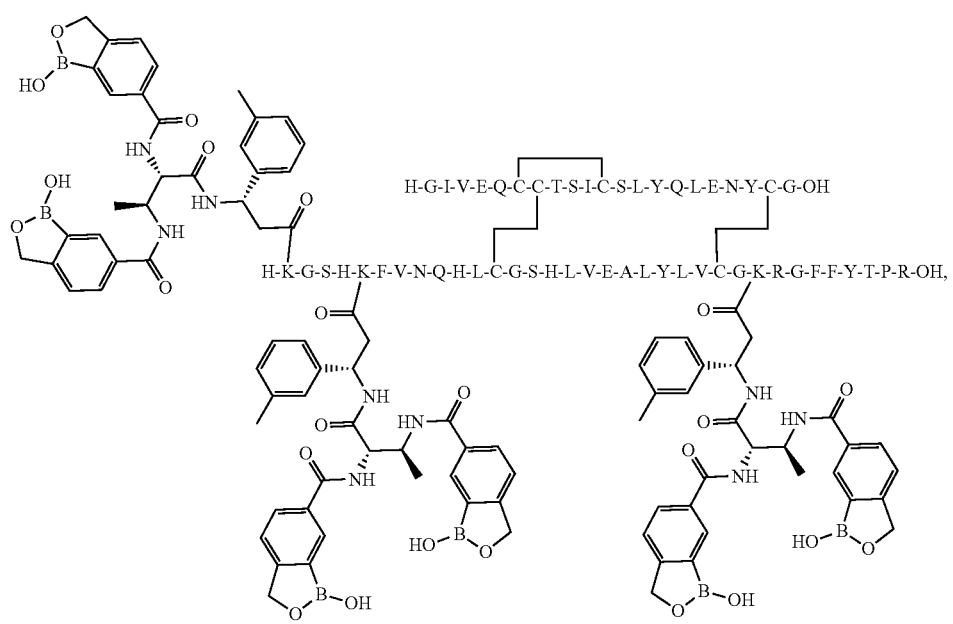
Example 123 (SEQ ID NOS 25638 and 25639, respectively, in order of appearance):

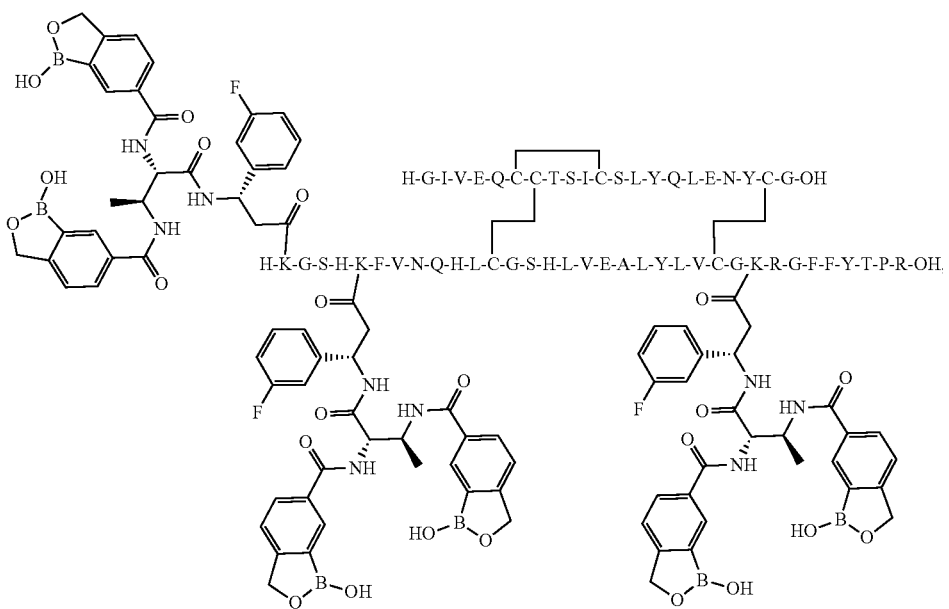
Example 124 (SEQ ID NOS 25640 and 25641, respectively, in order of appearance):
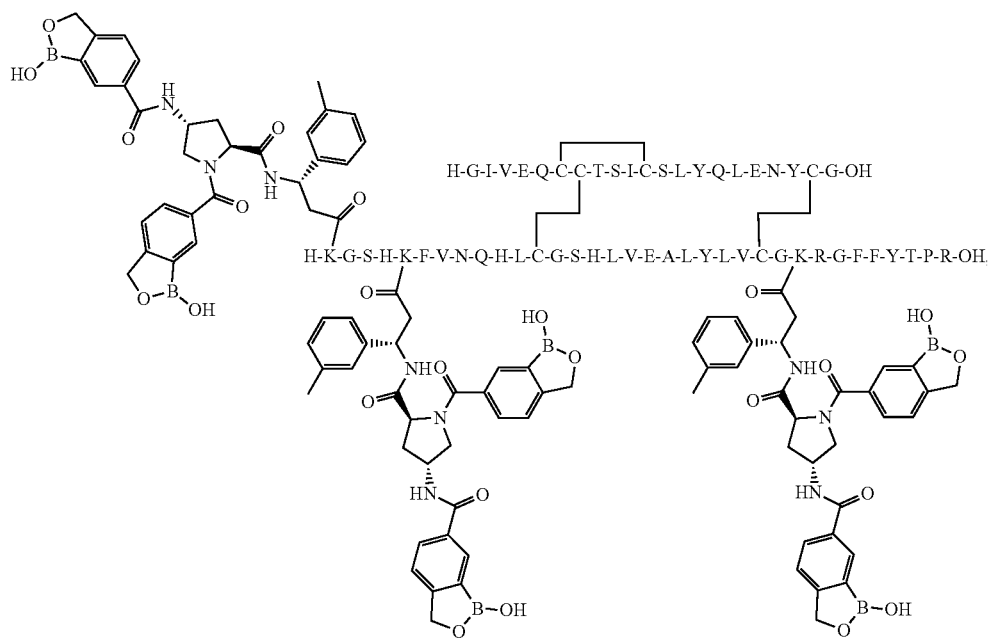
Example 125 (SEQ ID NOS 25642 and 25643, respectively, in order of appearance):

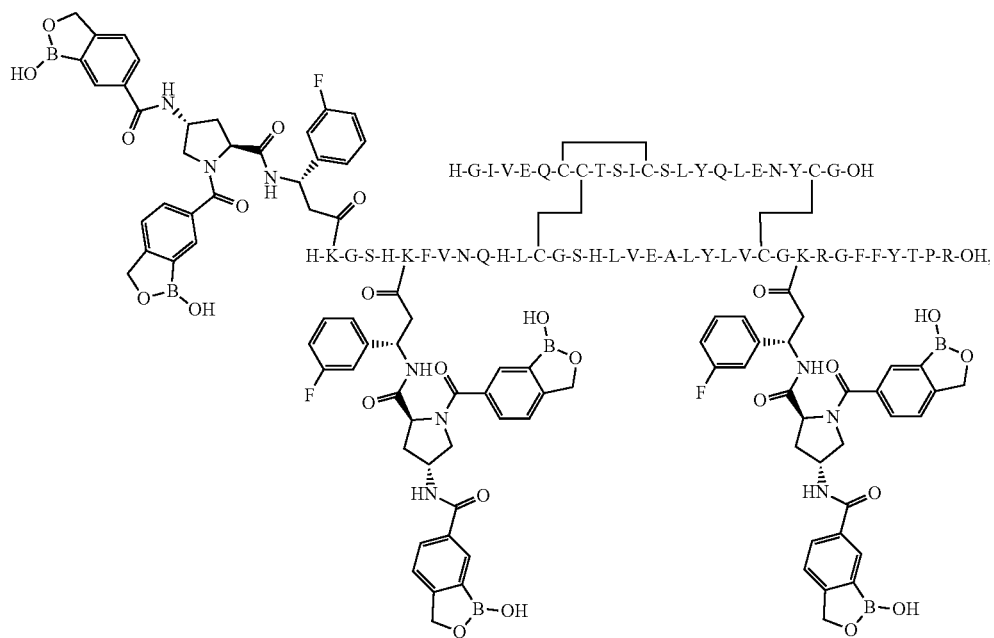
Example 126 (SEQ ID NOS 25644 and 25645, respectively, in order of appearance):
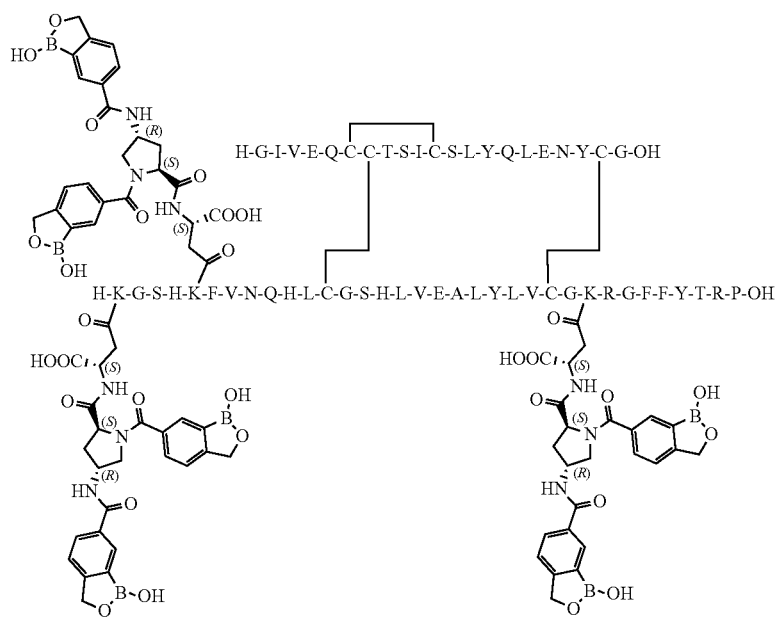
Example 127 (SEQ ID NOS 25646 and 25647, respectively, in order of appearance):

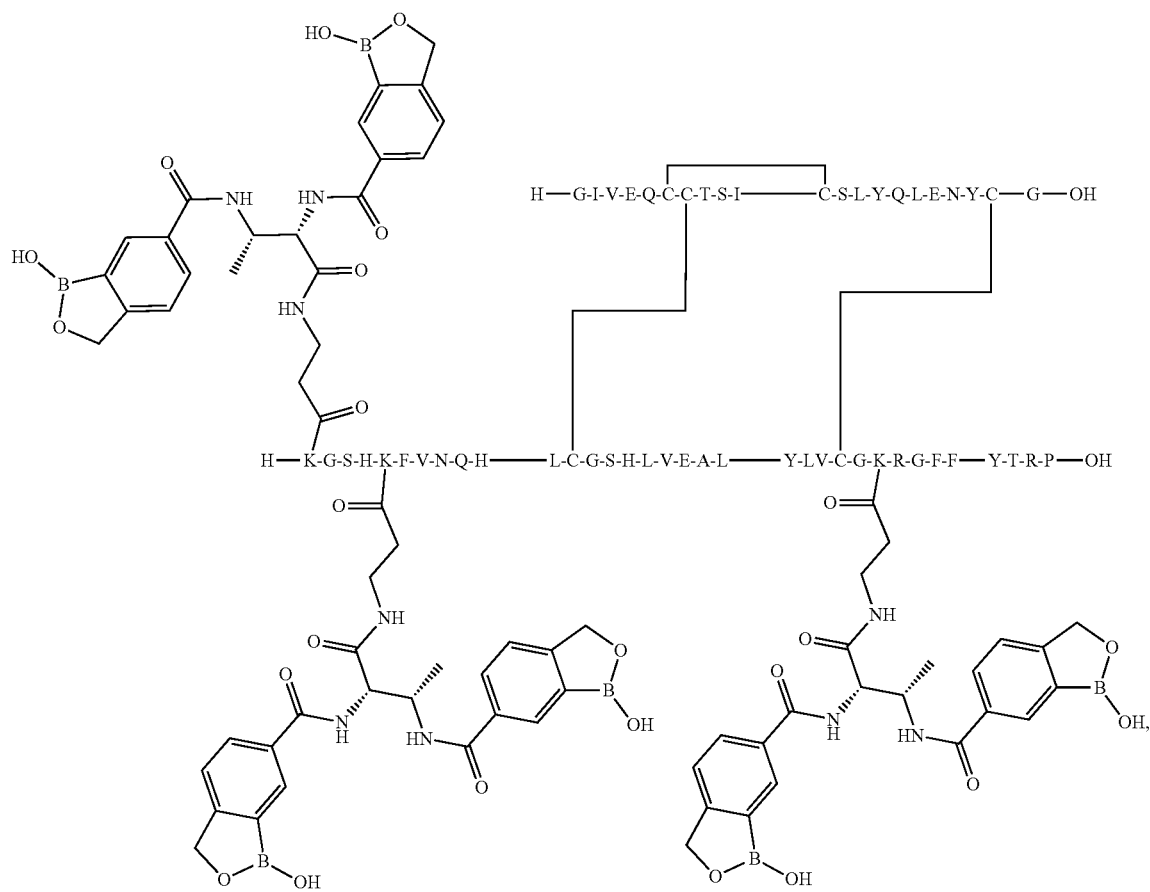
Example 128 (SEQ ID NOS 25648 and 25649, respectively, in order of appearance):

251
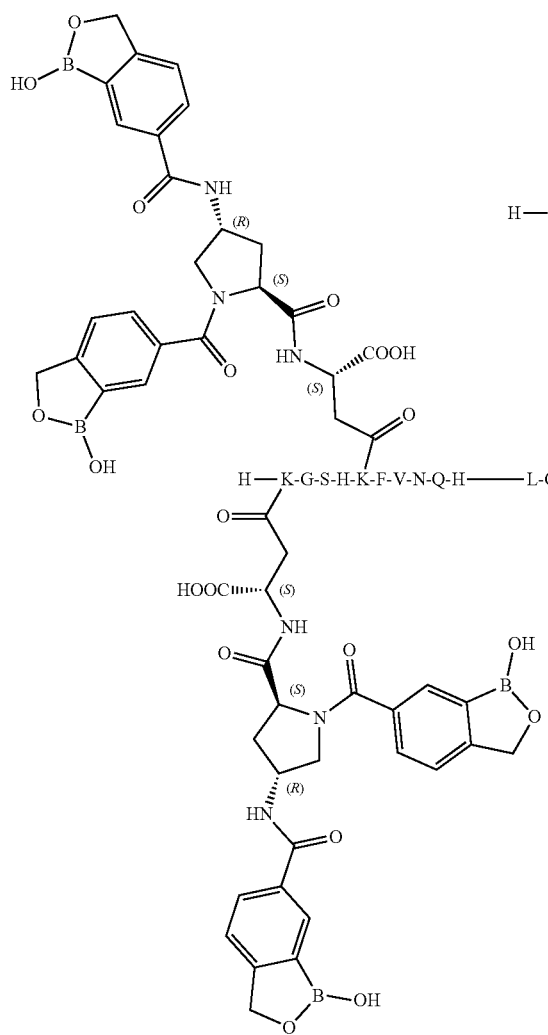
252
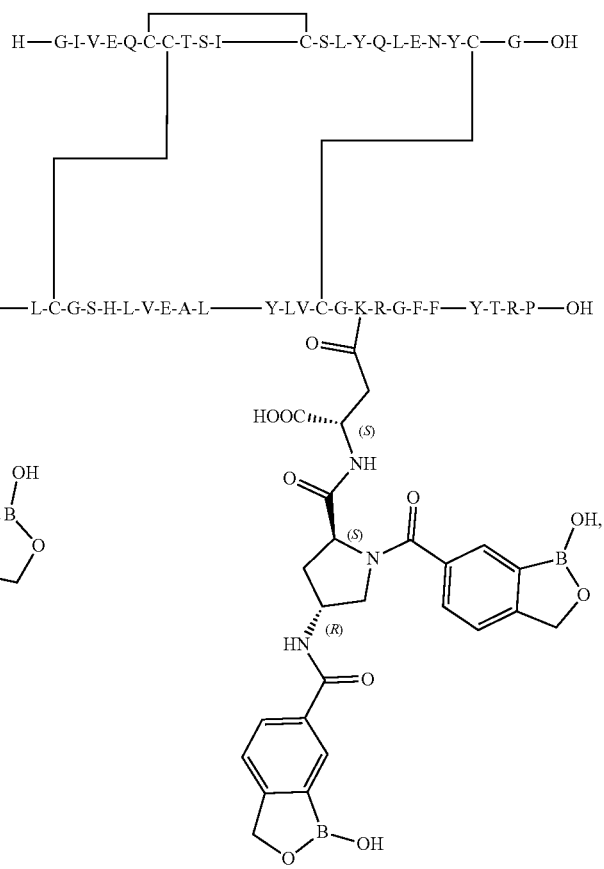
Example 129 (SEQ ID NOS 25650 and 25651, respectively, in order of appearance):

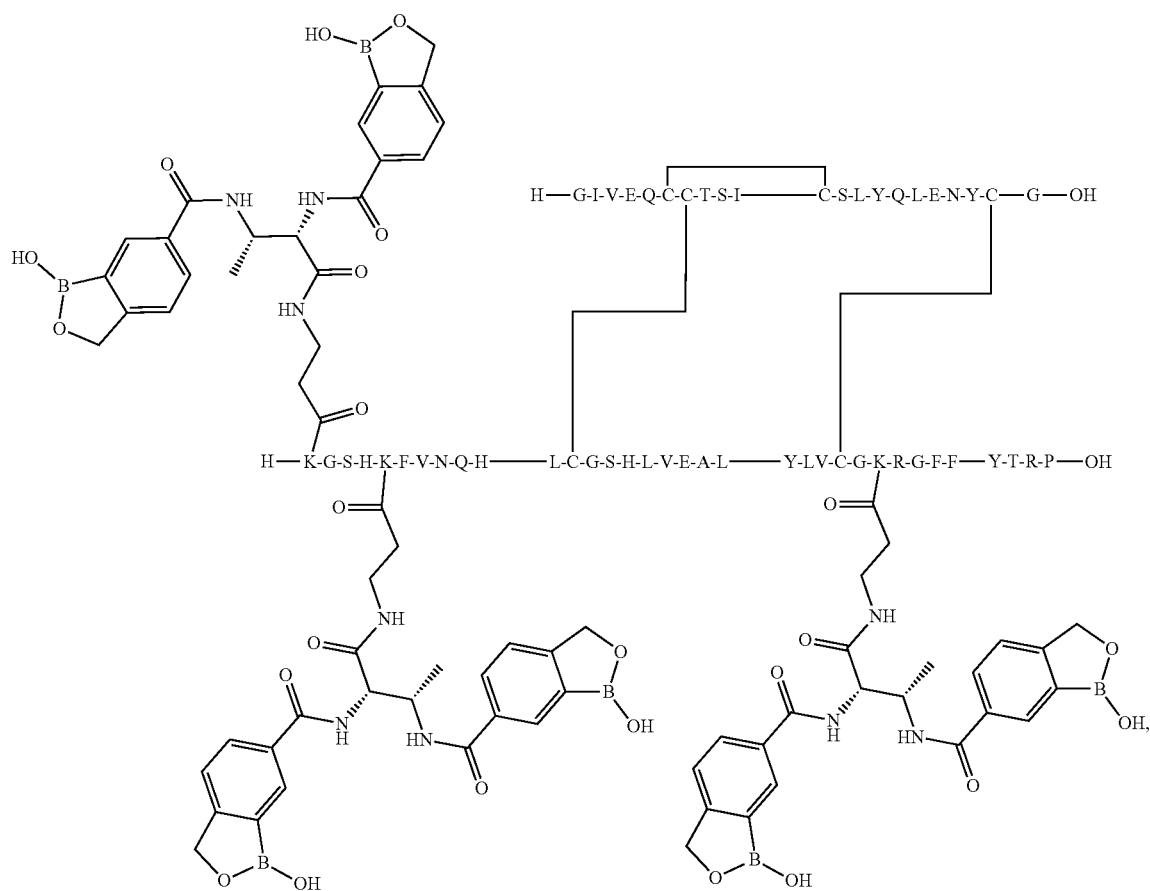
Example 130 (SEQ ID NOS 25652 and 25653, respectively, in order of appearance):

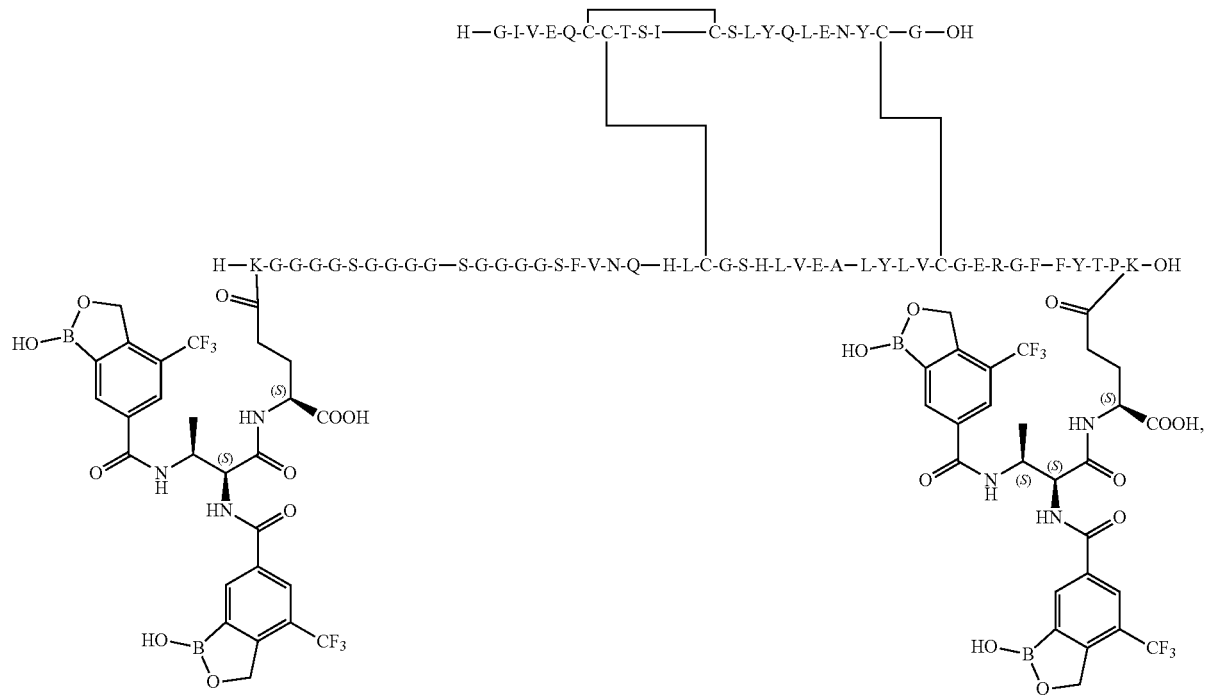
Example 131 (SEQ ID NOS 25654 and 25655, respectively, in order of appearance):
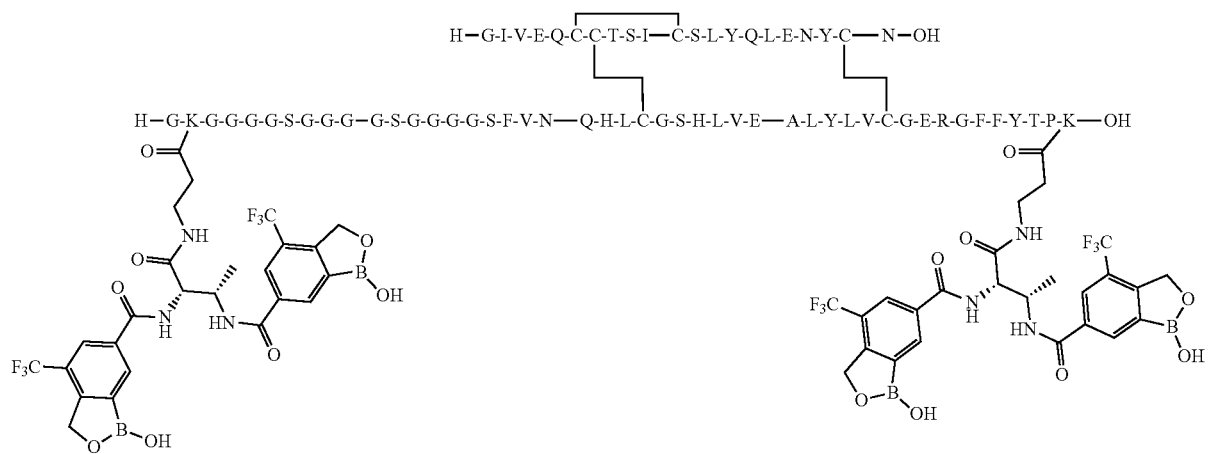
Example 132 (SEQ ID NOS 25656 and 25657, respectively, in order of appearance):

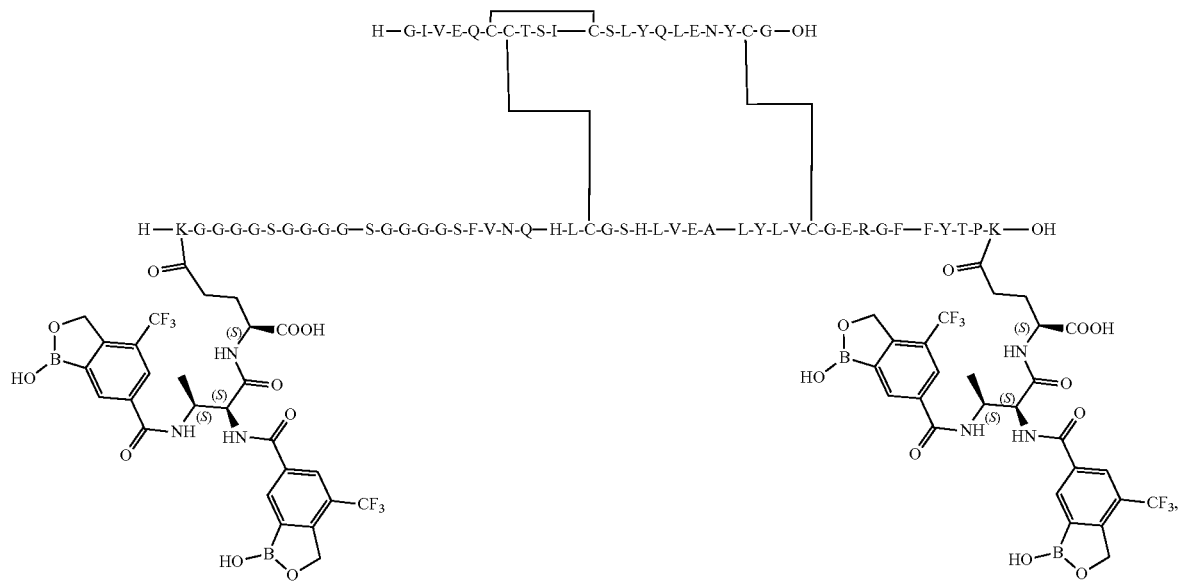
Example 133 (SEQ ID NOS 25658 and 25659, respectively, in order of appearance):
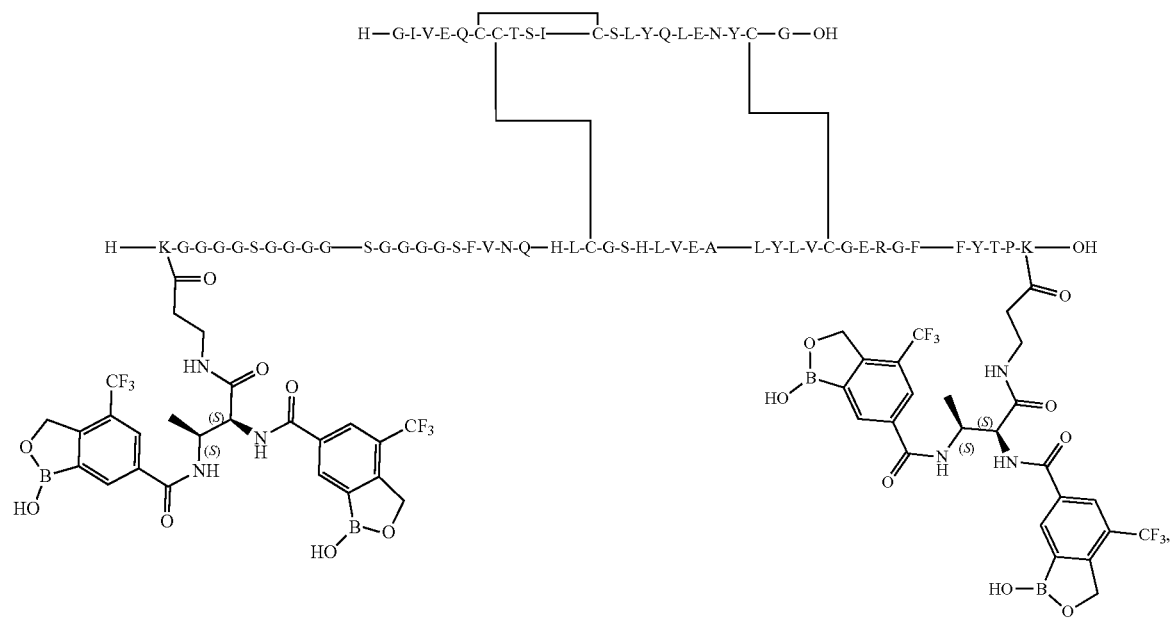
Example 134 (SEQ ID NOS 25660 and 25661, respectively, in order of appearance):

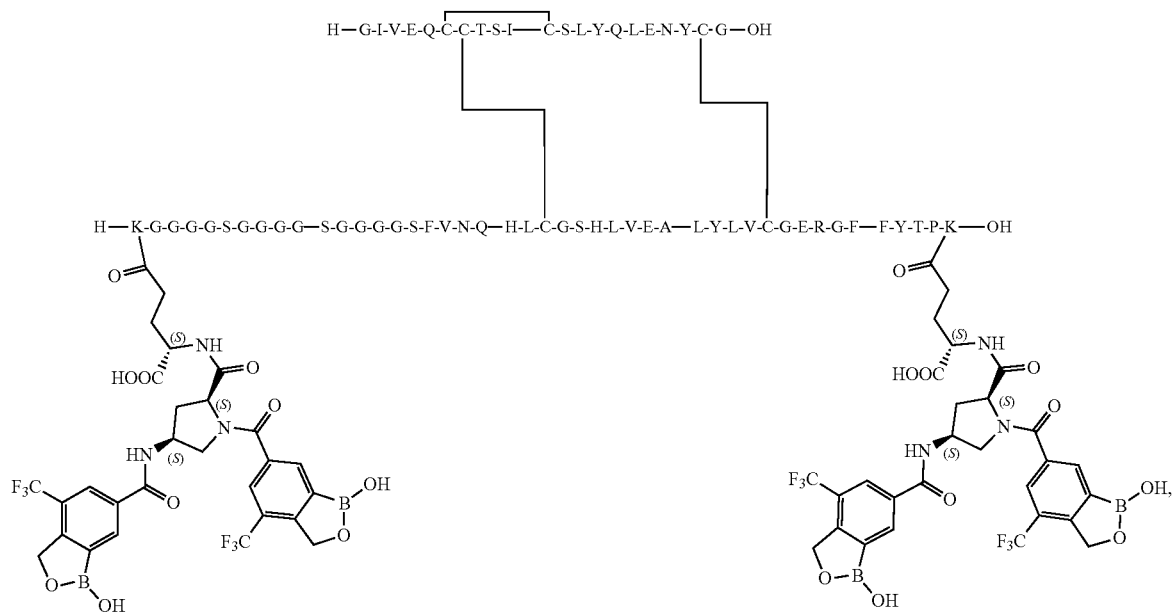
Example 135 (SEQ ID NOS 25662 and 25663, respectively, in order of appearance):
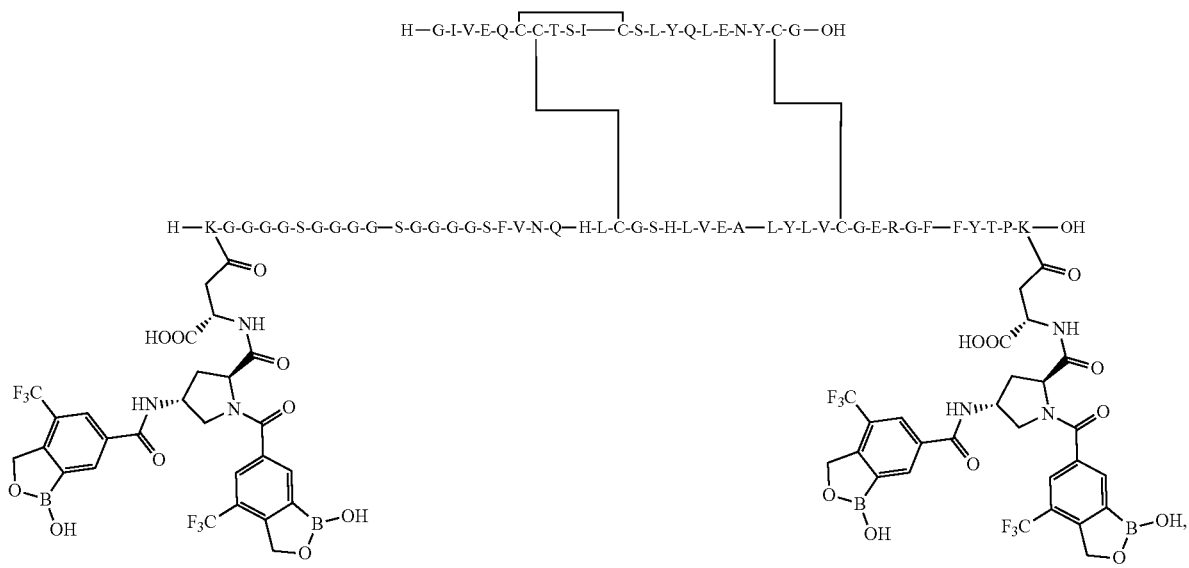

Example 136 (SEQ ID NOS 25664 and 25665, respectively, in order of appearance):
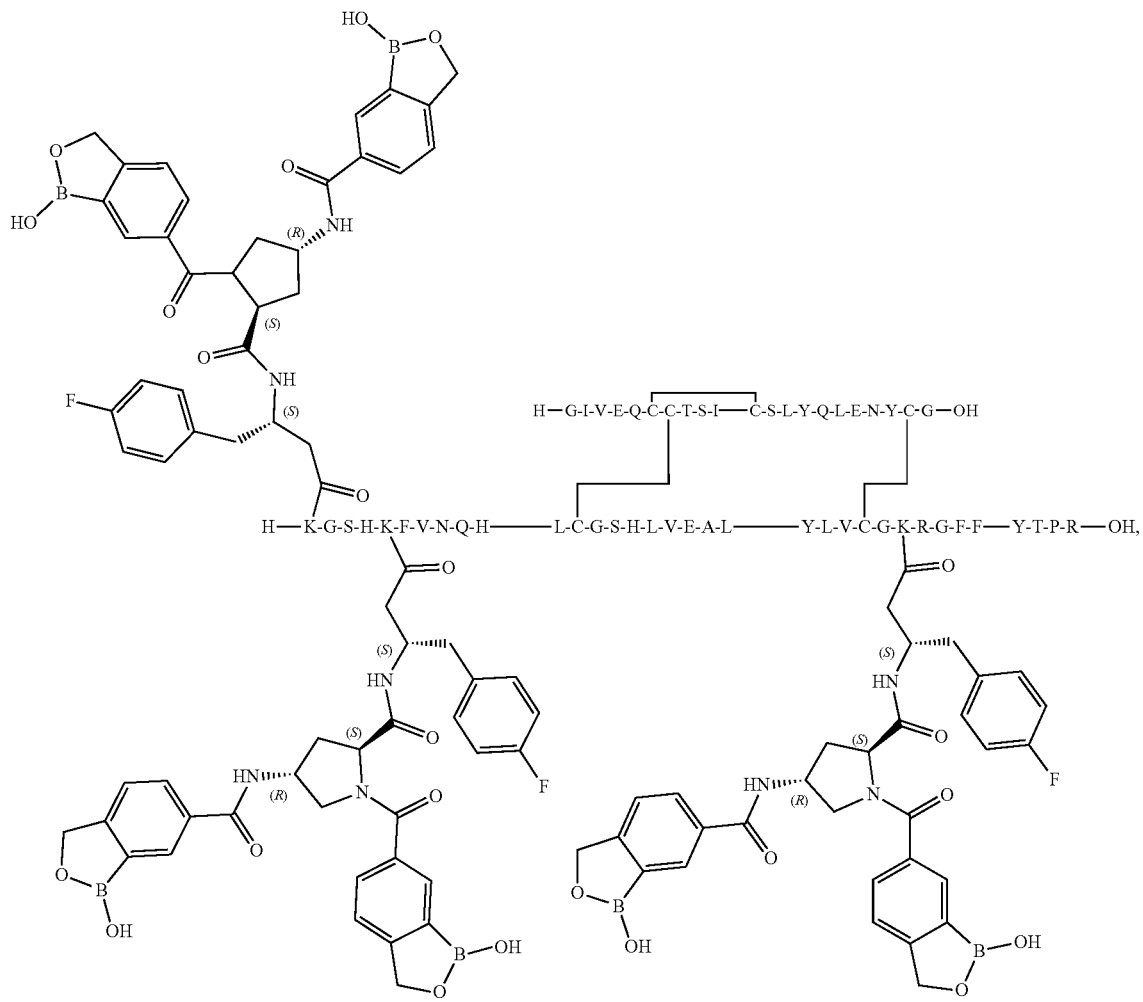

Example 137 (SEQ ID NOS 25666 and 25667, respectively, in order of appearance):
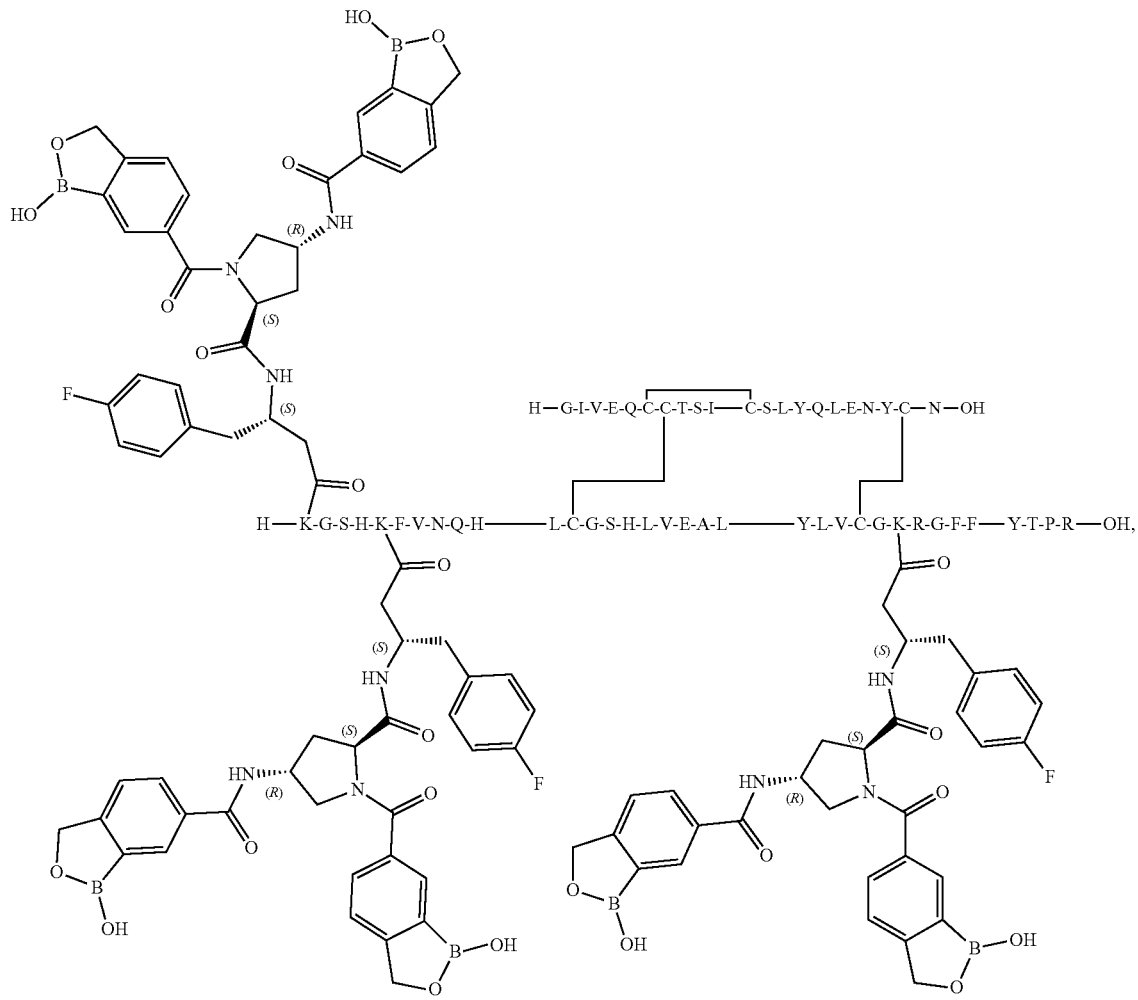

Example 138 (SEQ ID NOS 25668 and 25669, respectively, in order of appearance):
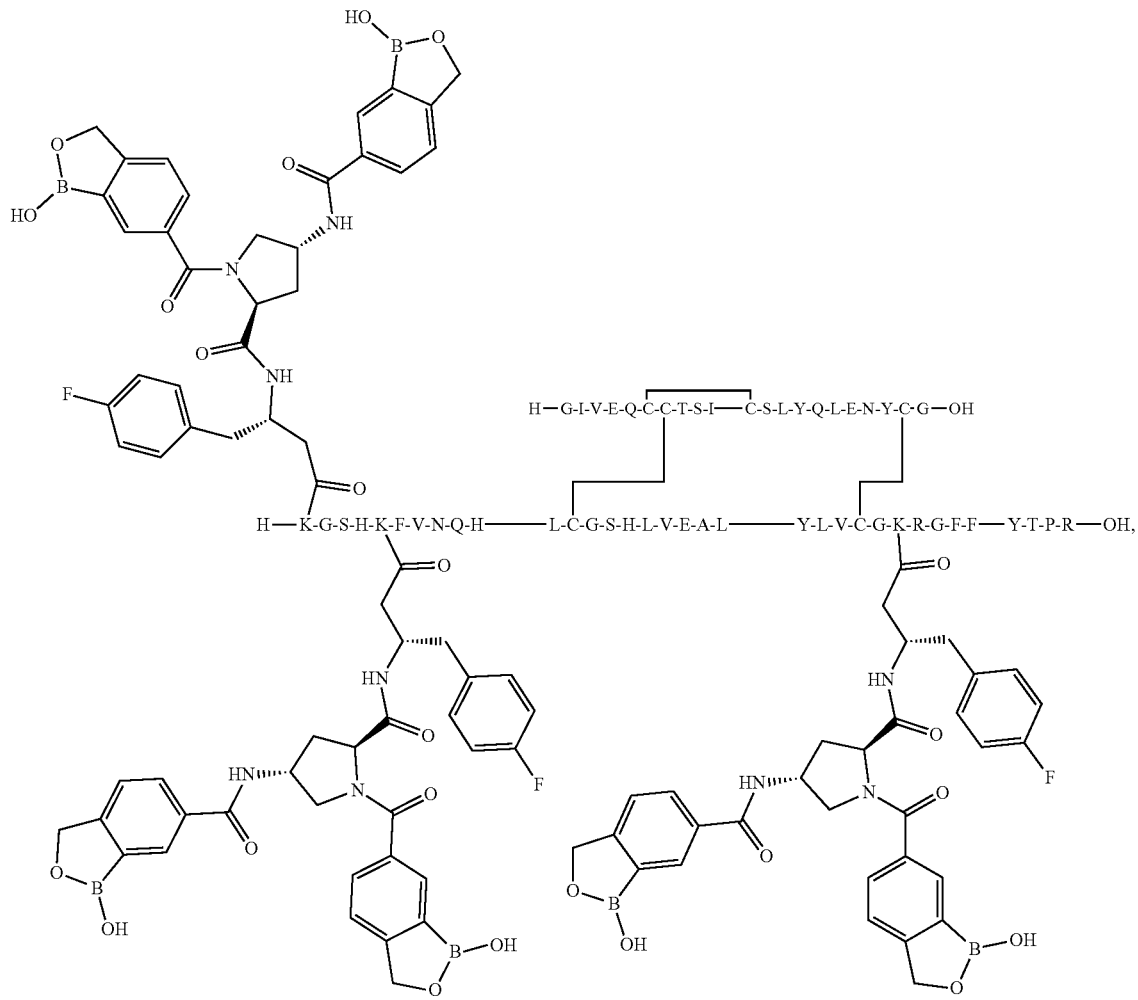

Example 139 (SEQ ID NOS 25670 and 25671, respectively, in order of appearance):
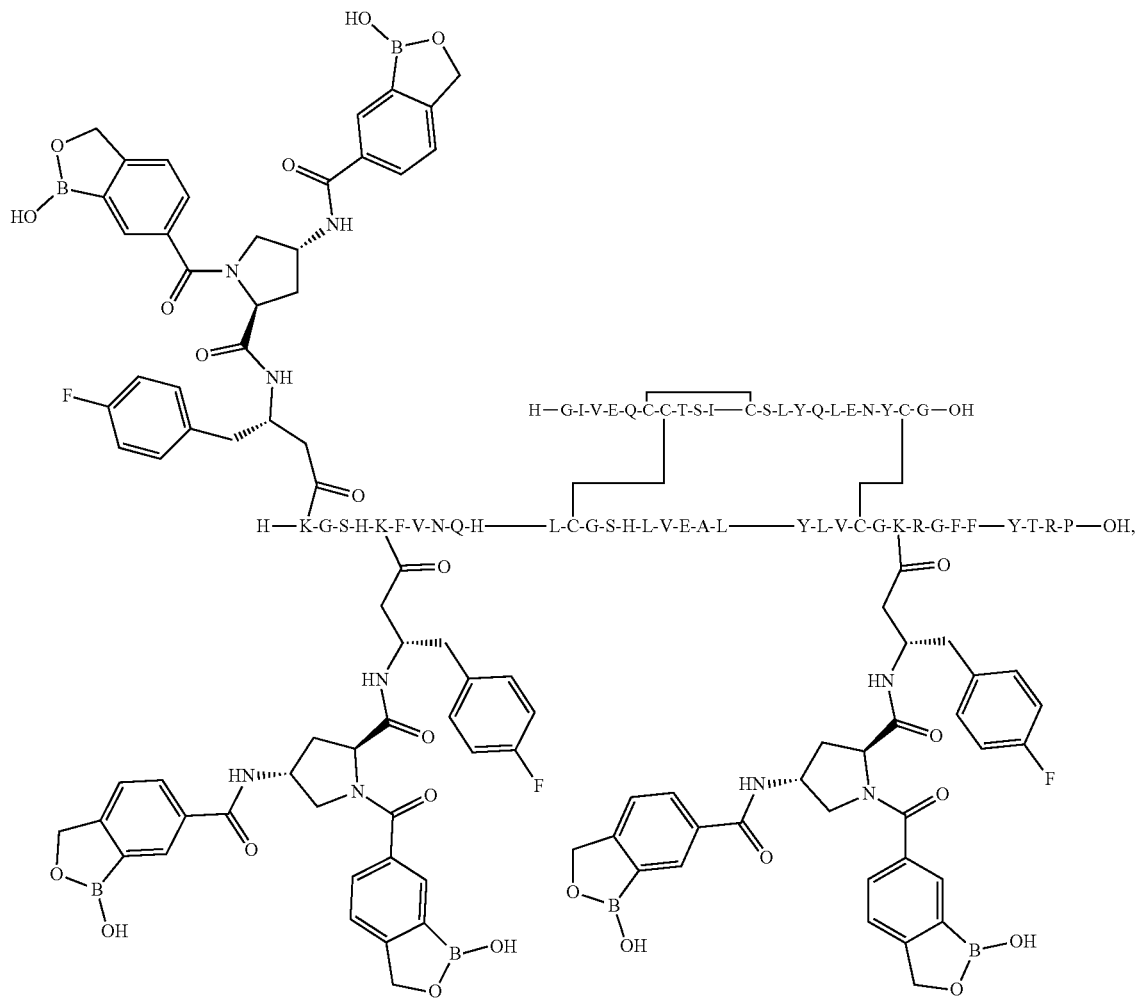

Example 140 (SEQ ID NOS 25672 and 25673, respectively, in order of appearance):
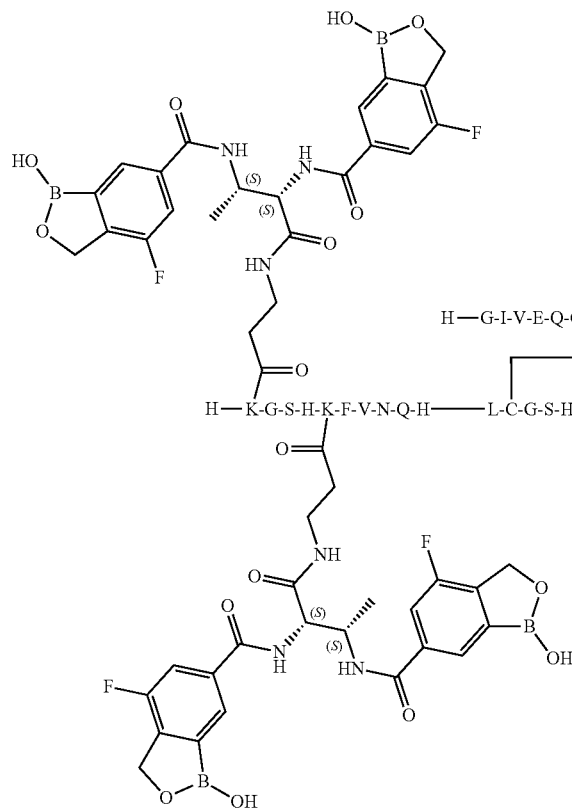
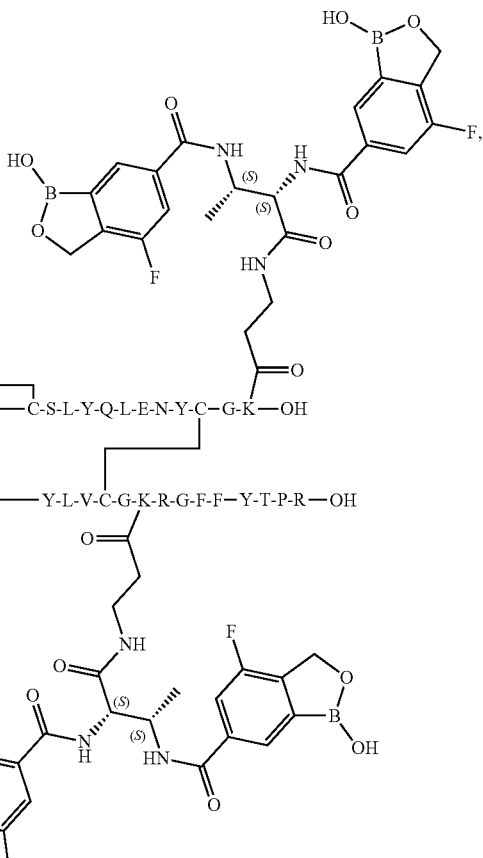

Example 141 (SEQ ID NOS 25674 and 25675, respectively, in order of appearance):
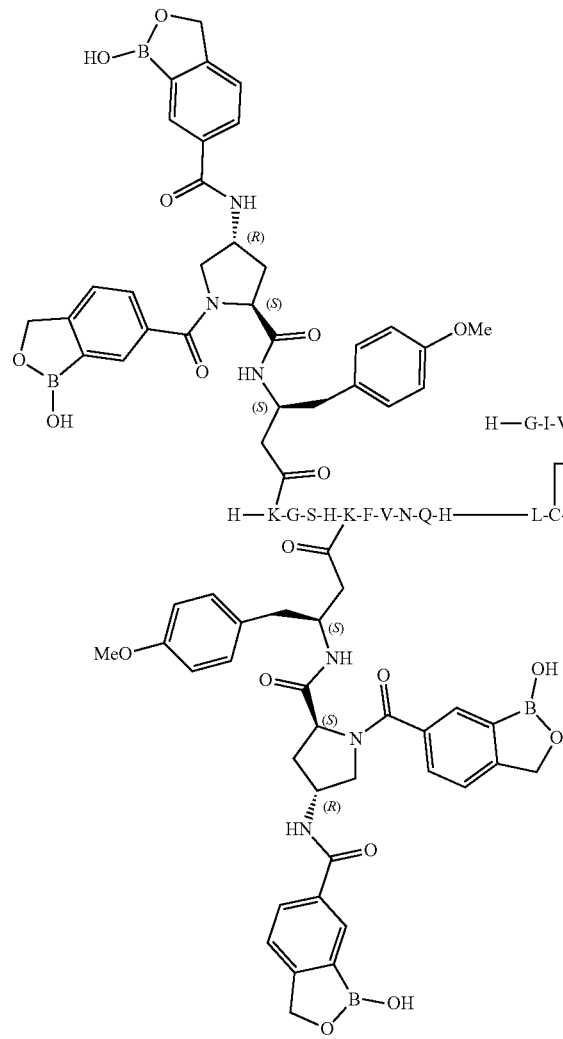
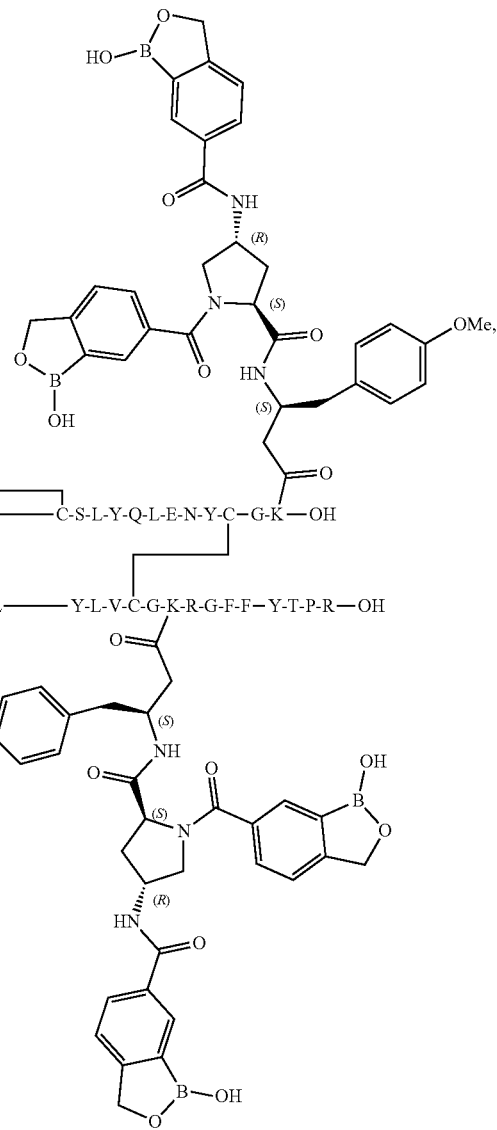

Example 142 (SEQ ID NOS 25676 and 25677, respectively, in order of appearance):
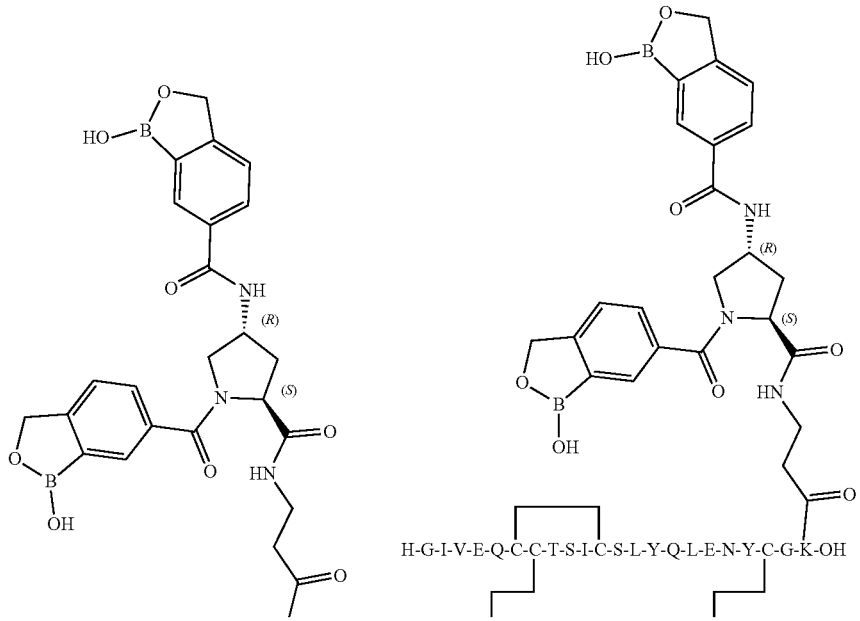
H-G-I-V-E-Q-C-C-T-S-I-C-S-L-Y-Q-L-E-N-Y-C-G-K-OH
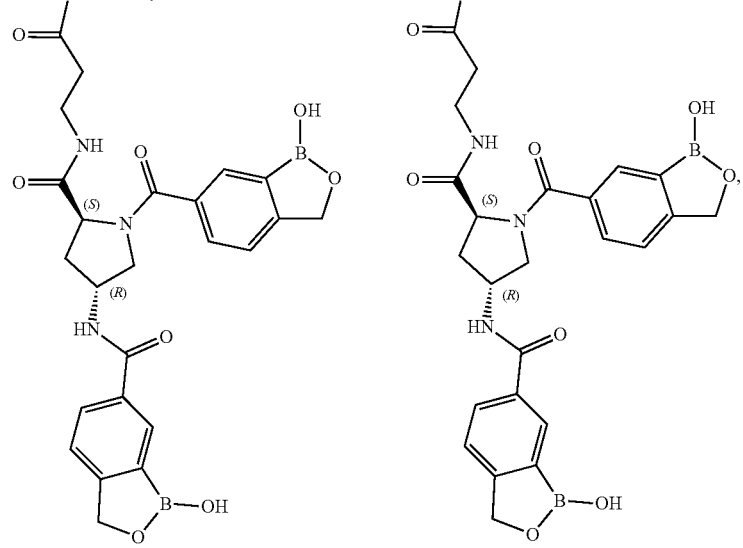
H-K-G-S-H-K-F-V-N-Q-H-L-C-G-S-H-L-V-E-A-L-Y-L-V-C-G-K-R-G-F-F-Y-T-P-R-OH Example 143 (SEQ ID NOS 25678 and 25679, respectively, in order of appearance):
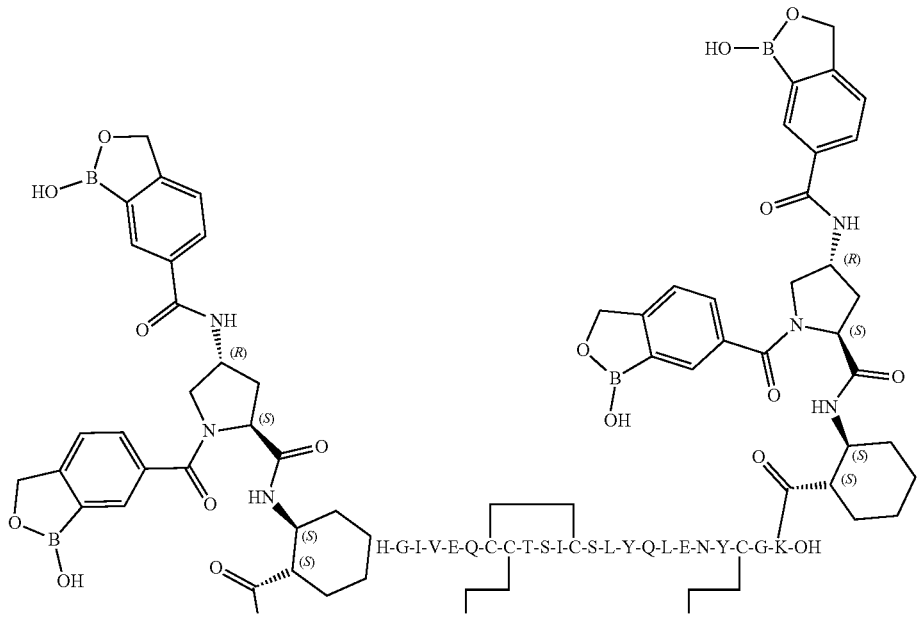

Example 144 (SEQ ID NOS 25680 and 25681, respectively, in order of appearance):
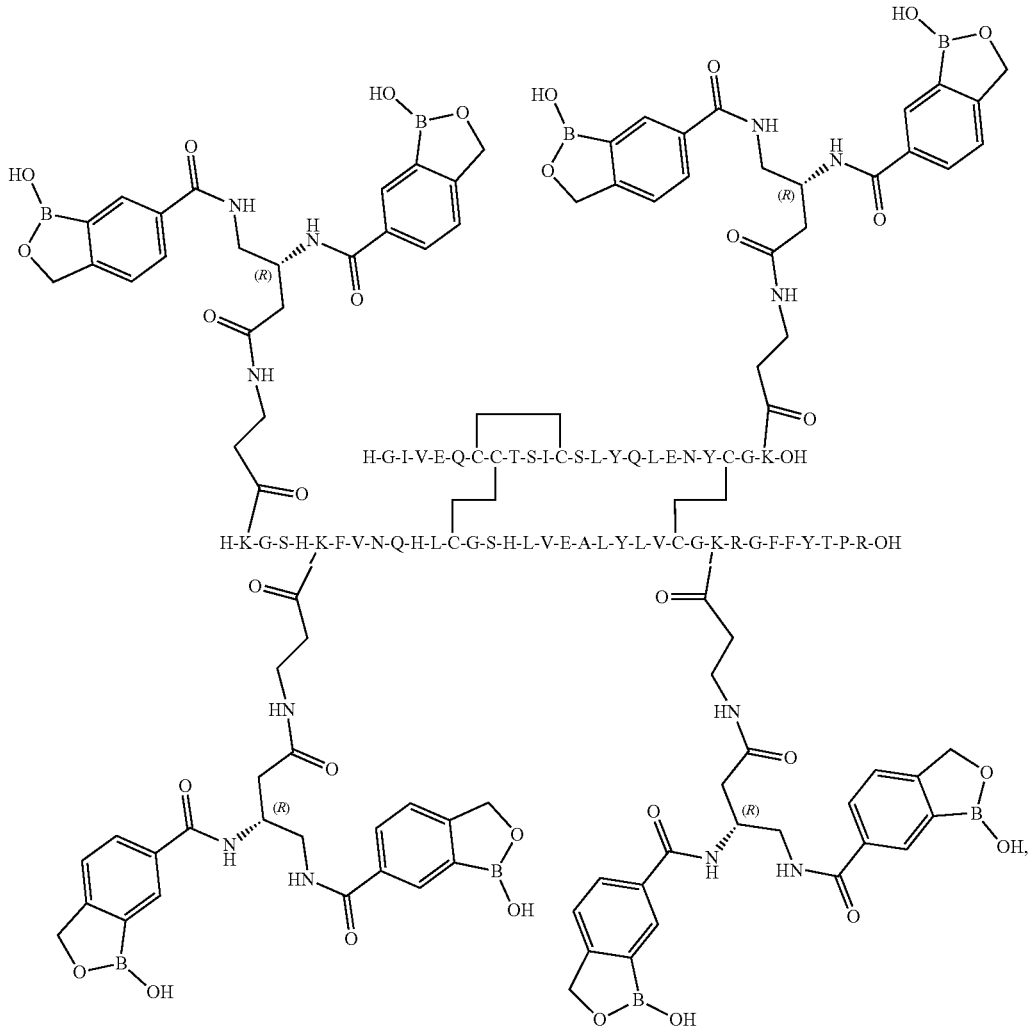
Example 145 (SEQ ID NOS 25682 and 25683, respectively, in order of appearance):
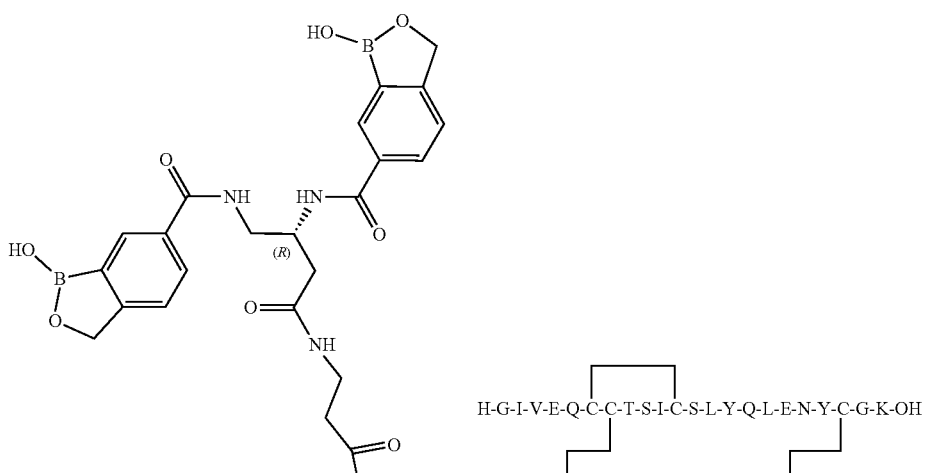

-continued
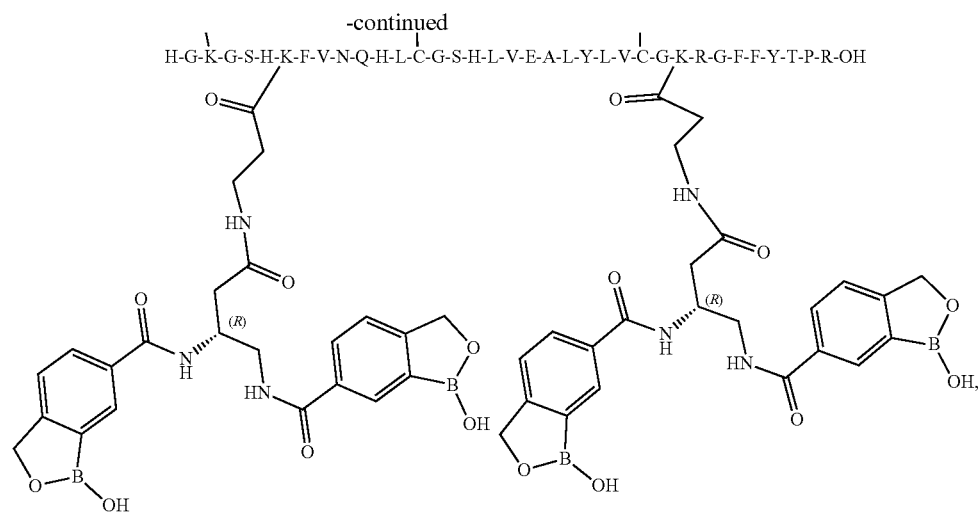
Example 146 (SEQ ID NOS 25684 and 25685, respectively, in order of appearance):
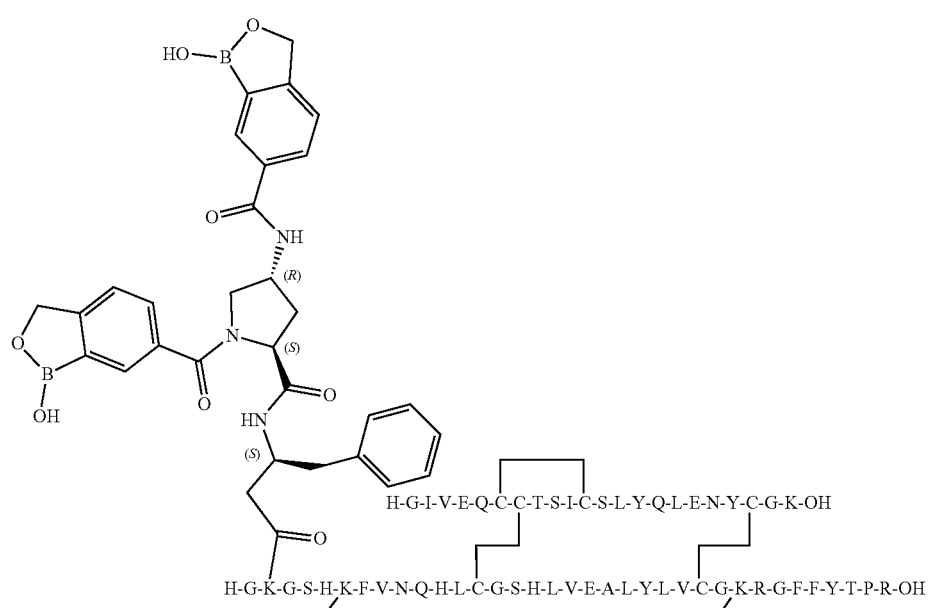

281 282
-continued
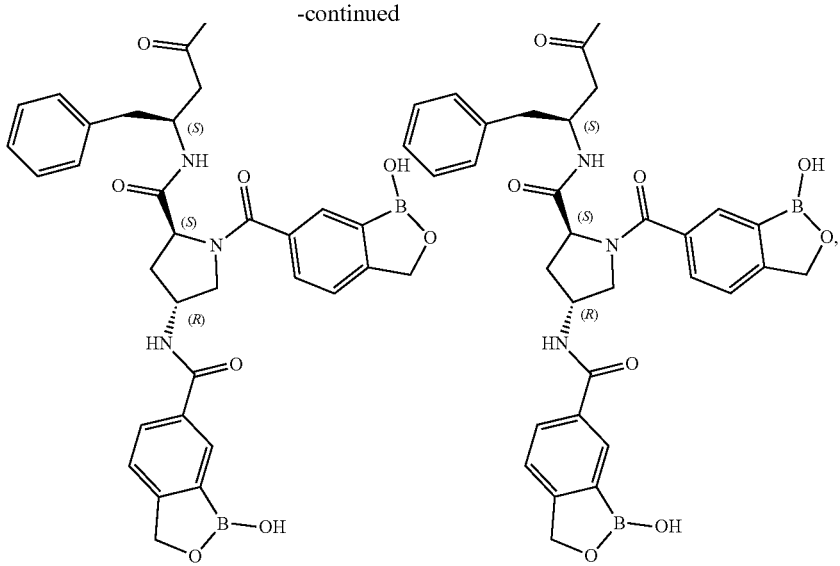
Example 147 (SEQ ID NOS 25686 and 25687, respectively, in order of appearance):
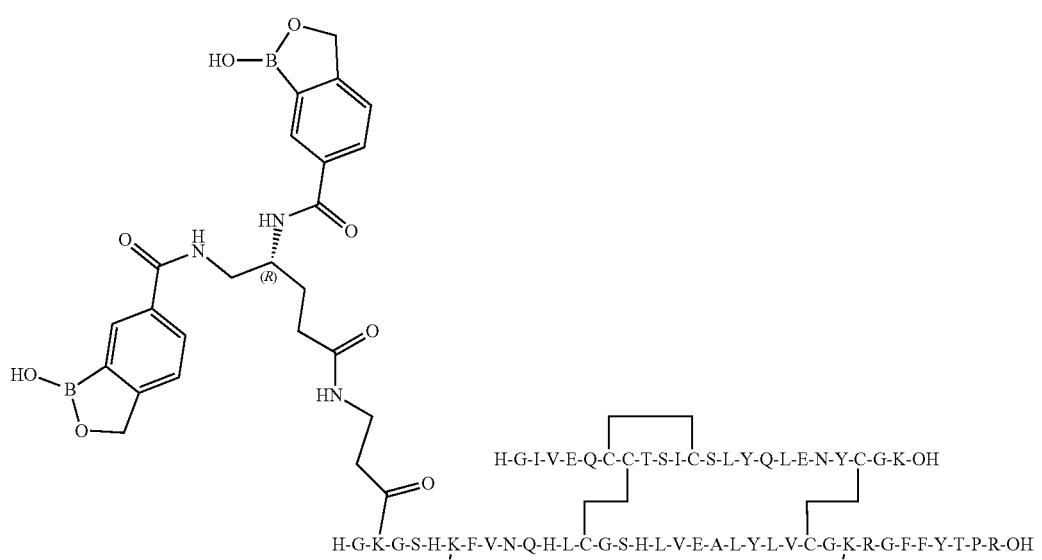

283 284
-continued
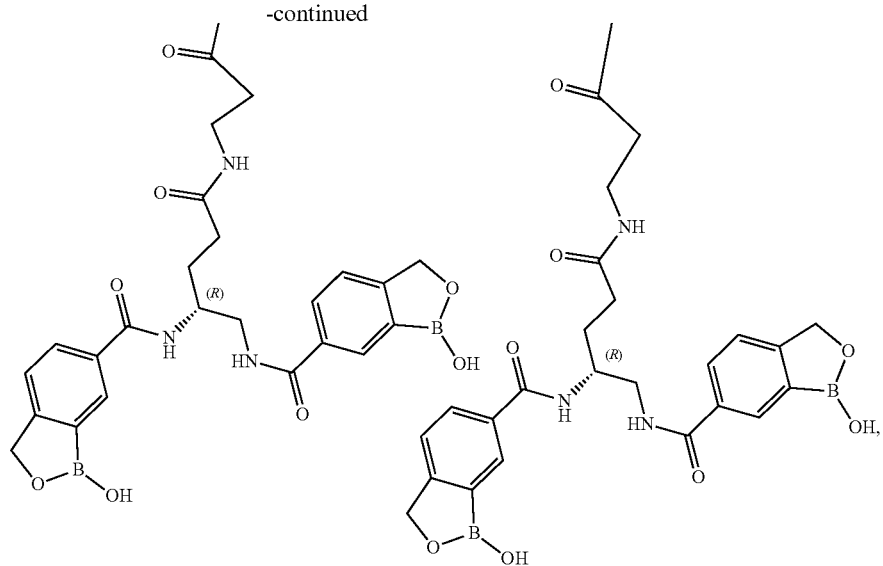
Example 148 (SEQ ID NOS 25688 and 25689, respectively, in order of appearance):
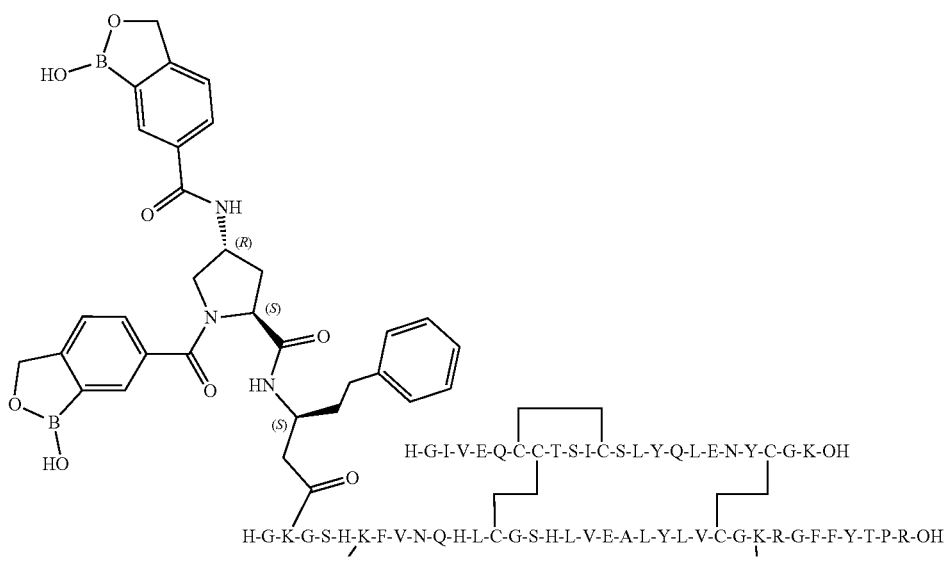

285
286
-continued
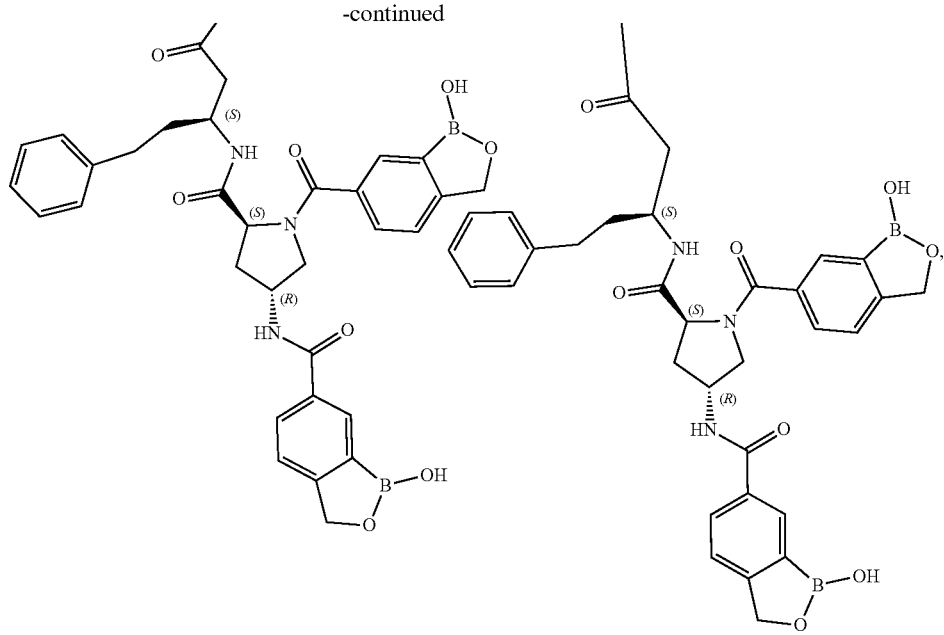
Example 149 (SEQ ID NOS 25690 and 25691, respectively, in order of appearance):
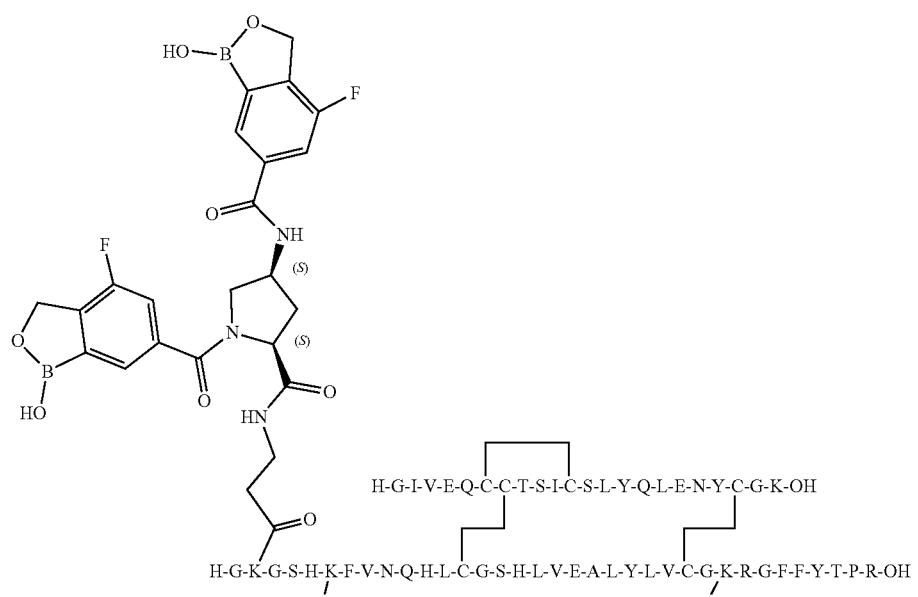

287 288
-continued
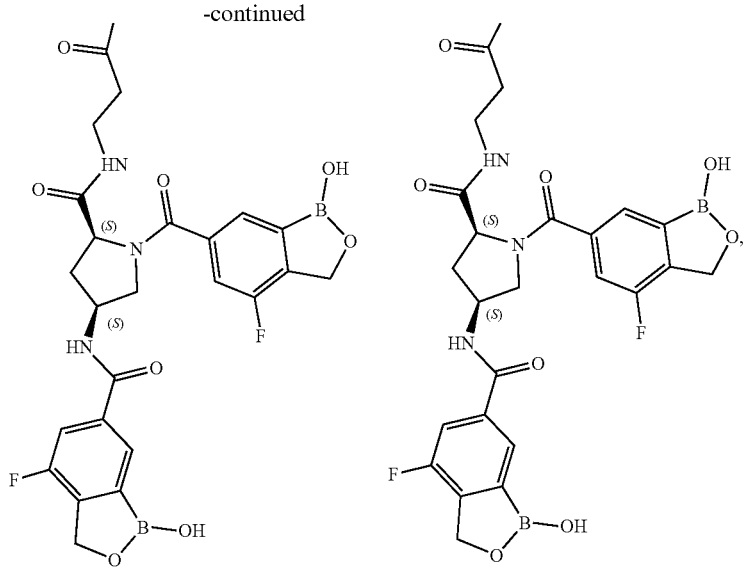
Example 150 (SEQ ID NOS 25692 and 25693, respectively, in order of appearance):
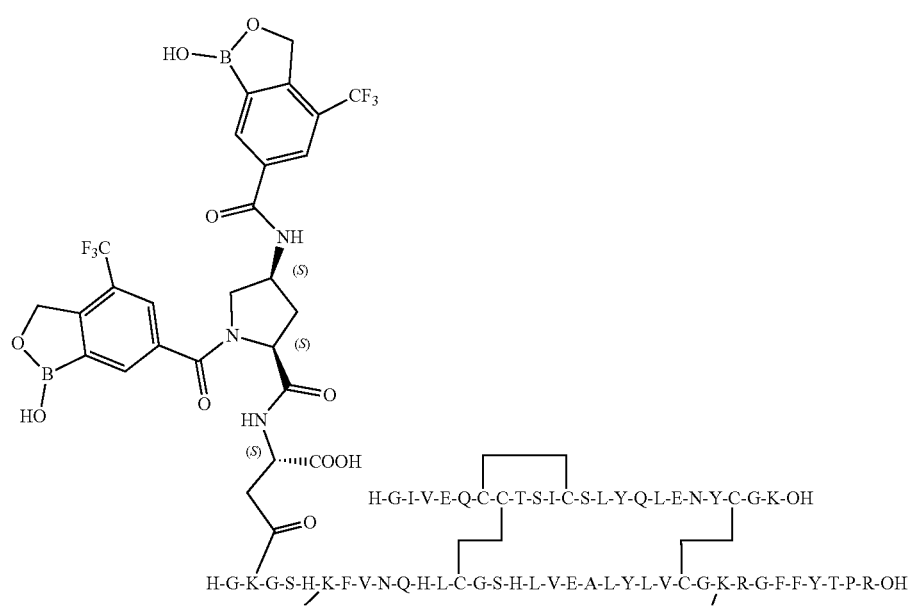

289 290
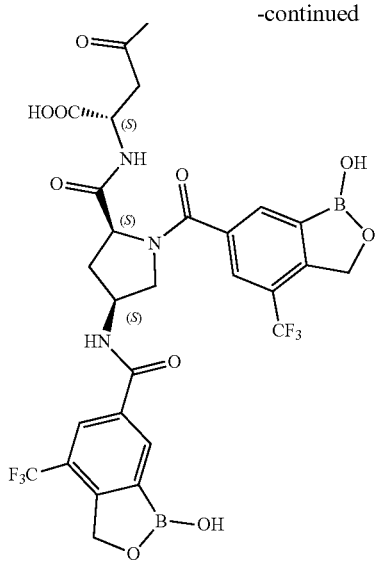
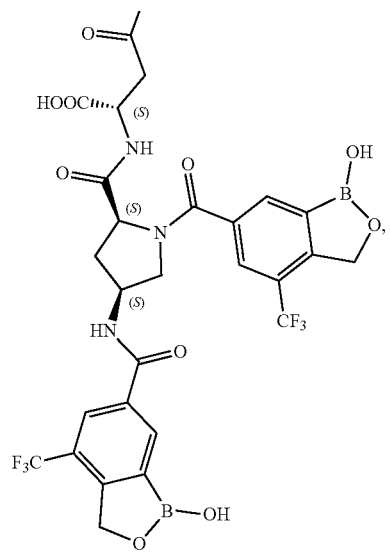
Example 151 (SEQ ID NOS 25694 and 25695, respectively, in order of appearance):
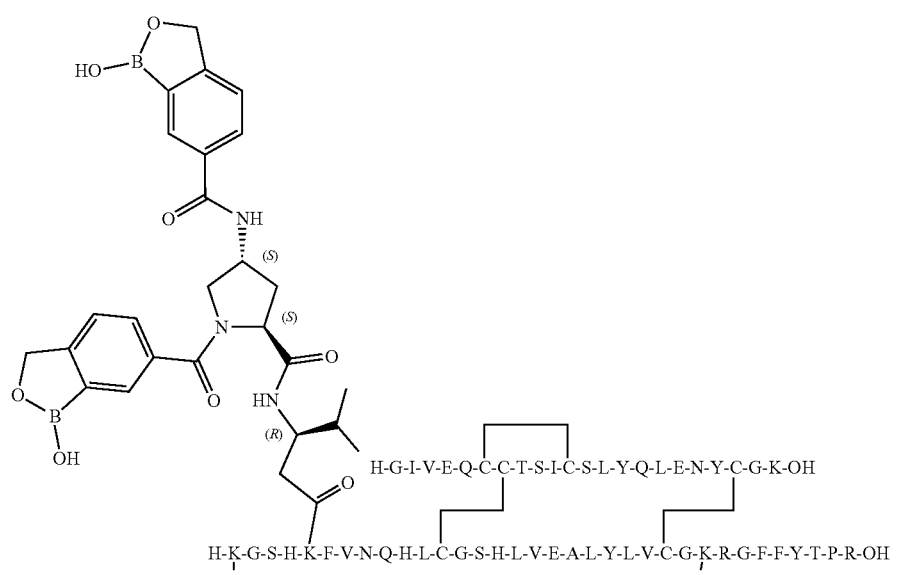

291
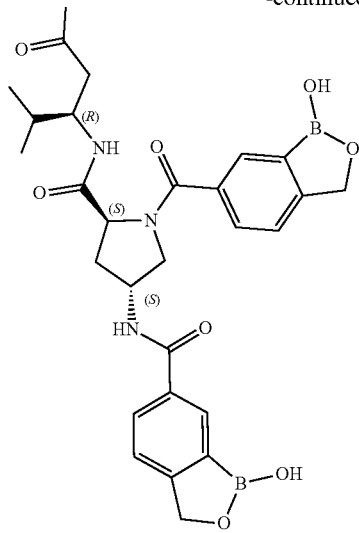
292
-continued
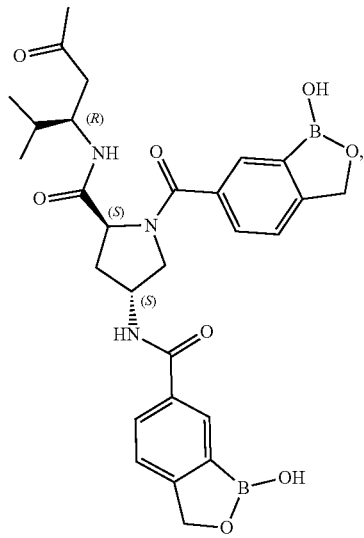
Example 152 (SEQ ID NOS 25696 and 25697, respectively, in order of appearance):
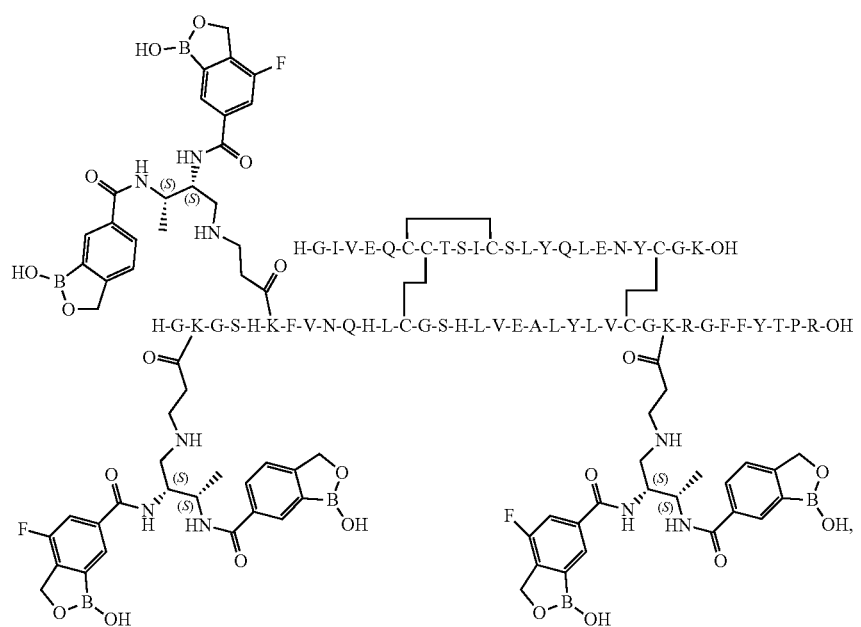
Example 153 (SEQ ID NOS 25698 and 25699, respectively, in order of appearance):

293
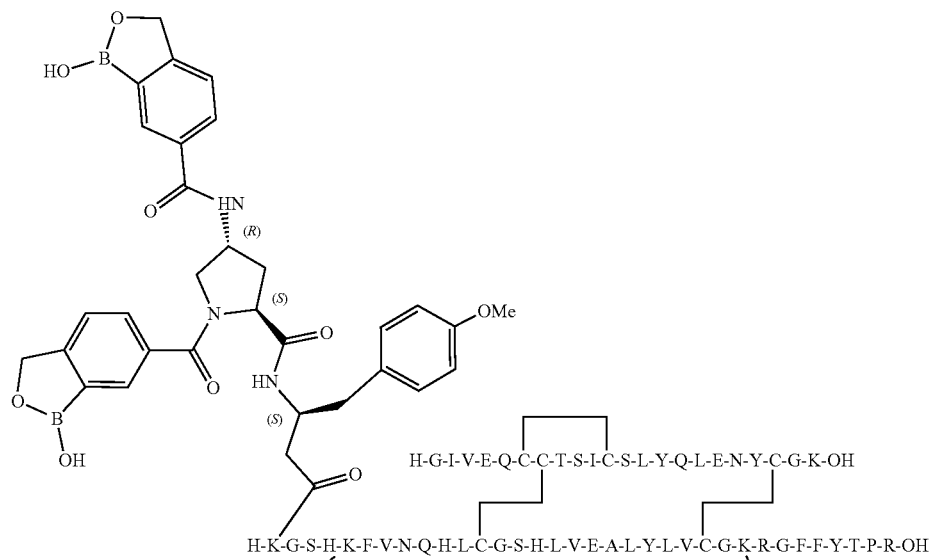
294
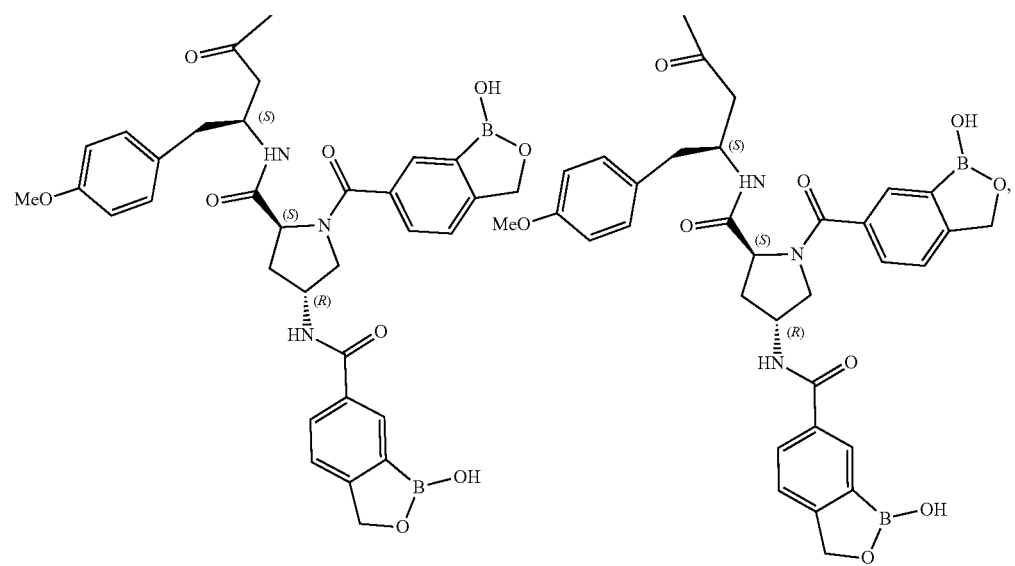

Example 154 (SEQ ID NOS 25700 and 25701, respectively, in order of appearance):
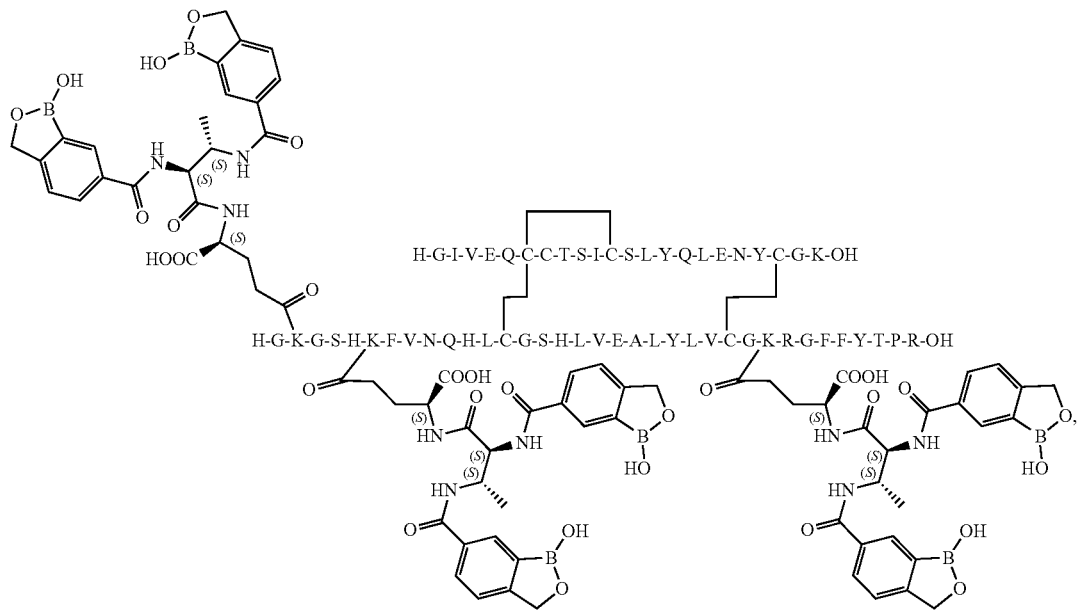
Example 155 (SEQ ID NOS 25702 and 25703, respectively, in order of appearance):
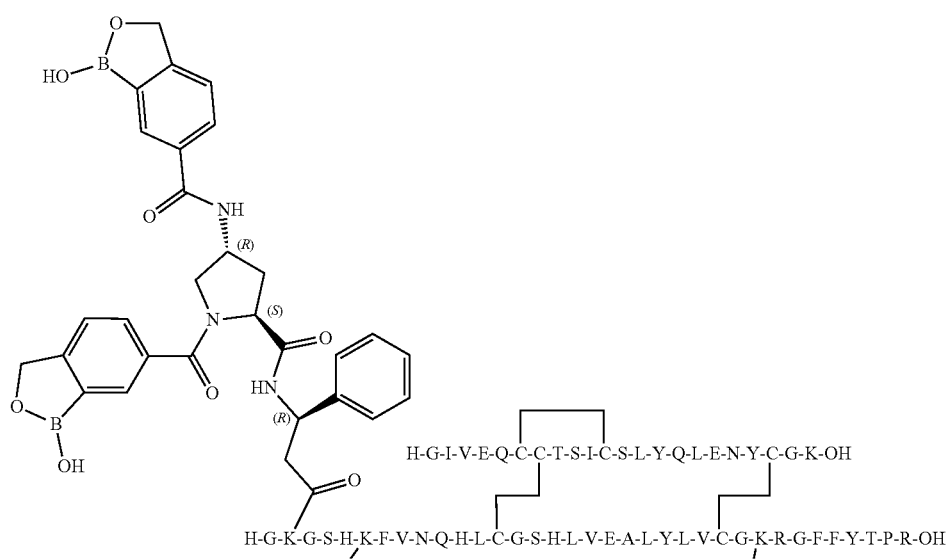

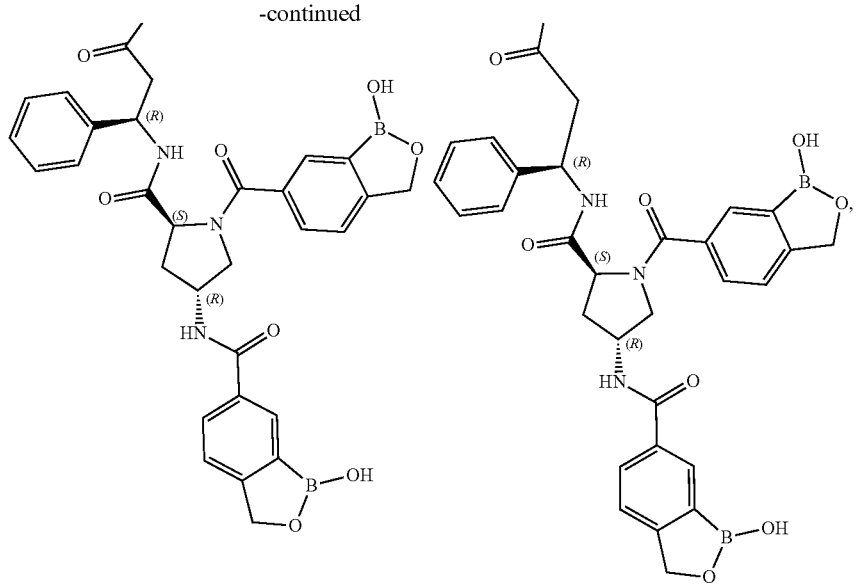

Example 156 (SEQ ID NOS 25704 and 25705, respectively, in order of appearance):

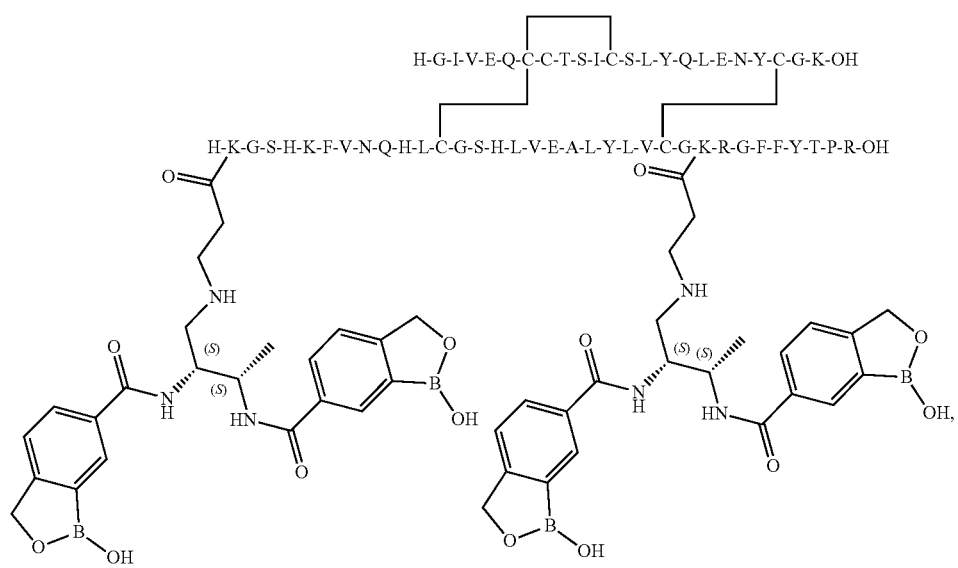

a stereoisomer thereof, a pharmaceutically acceptable salt thereof, an isotope thereof, and combinations thereof.

In some embodiments, provided herein are compounds selected from the group consisting of an insulin comprising an A-chain and a B-chain, wherein the A-chain comprises a sequence selected from SEQ ID NOs 24501 and 24502; and wherein the B-chain comprises a sequence selected from SEQ ID NOs 25229, 25232, 25305, 25308, 25312, 25236, 25095, and 25380-25397.

In some embodiments, each indirect linker is independently selected from FL3, FL5, FL5A, FL5B, FL32, FL41, FL62, FL63, and stereoisomers thereof.

In some embodiments, the $B_1$ and the $B_2$ are selected from Formula F2, and each remaining $R_1$ is independently selected from H, F, CL, I, Br, and $CF_3$.

In some embodiments, the $B_1$ and the $B_2$ are selected from Formula F2, and each remaining $R_1$ is H.

In some embodiments, X1 comprises at least one lysine and an N-terminus; each Z1c is independently selected from FF12A, FF12B, FF12C, FF12D, FF116, FF116A, FF116B, FF116C, FF116D, wherein each $B_1$ and $B_2$ is F2; each Z1c is conjugated, either directly or via the indirect linker, to an amine side chain in the lysine in X1 or to the N-terminus in X1; and each indirect linker is independently selected from FL3, FL5, FL5A, FL5B, and FL20-FL75, and stereoisomers thereof, wherein in FL3 and FL5 each p is independently 1, 2, or 3.

In some embodiments, at least one Z1c is conjugated via the indirect linker to an amine side chain in the lysine in the B-chain or to the B chain N-terminus.

In some embodiments, X1 comprises two or more lysine amino acids.

In some embodiments, the B-chain comprises at least two lysine amino acids each independently conjugated either directly or via an indirect linker to a Z1c.

In some embodiments, the B-chain comprises at least three lysine amino acids each independently covalently conjugated via the indirect linker to a Z1c.

In some embodiments, the A-chain comprises one or more lysine amino acids each independently covalently conjugated either directly or via an indirect linker to a Z1c.

In some embodiments, X1 comprises an A-chain having at least one lysine covalently conjugated via the indirect linker to a Z1c.

In some embodiments, the compound of Formula I is selected from:

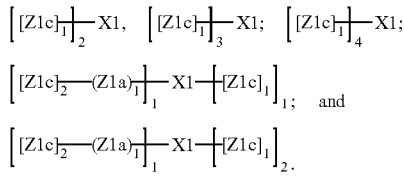

In some embodiments, at least one Z1c is covalently conjugated to X1 via the indirect linker, and wherein the indirect linker is independently selected from:

Formula FL3

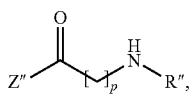

(FL3)

wherein p is 2 or 3;

Formulae FL5, FL5A, and FL5B

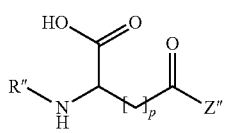

(FL5)

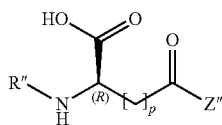

(FL5A)

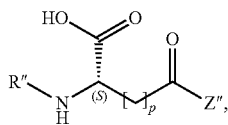

(FL5B)

wherein p is 1 or 2; and

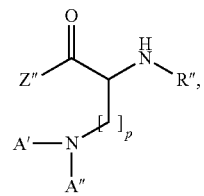

FL69 and stereoisomers thereof;
wherein:
R″ represents a covalent bond, directly or indirectly, to Z1c;
Z″ represents a covalent bond, directly or indirectly, to X1 or to Z1a;
A' is selected from H, an alkyl group (e.g., $C_1$-$C_6$alkyl group), a saturated fatty acid, an unsaturated fatty acid, a cycloalkyl group (e.g., ($C_3$-$C_6$)cycloalkyl), a haloalkyl group (e.g., $C_1$-$C_6$ haloalkyl group), an aryl group, and a heteroaryl group; and
A″ is selected from an alkyl group (e.g., $C_1$-$C_6$alkyl group), a substituted acyl group, acyl group terminating in an acid group, a saturated or unsaturated fatty acid, a cycloalkyl group (e.g., ($C_3$-$C_6$)cycloalkyl), a haloalkyl group (e.g., $C_1$-$C_6$haloalkyl group), an aryl group, and a heteroaryl group;
p is 1, 2, 3, 4, or 5, and
any primary amine is optionally acetylated or alkylated.

In some embodiments, the indirect linker is selected from:

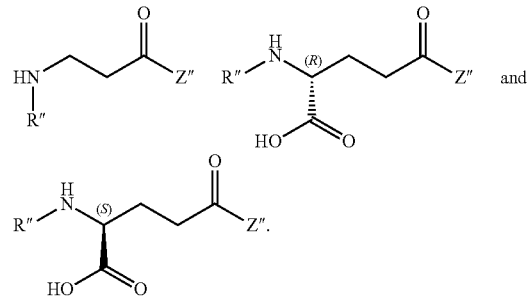

In some embodiments, X1 is an insulin further comprising from 1 to 5 residues replaced, inserted, appended, or mutated to an amino acid that has a free amine conjugated directly or indirectly to a Z1c.

In some embodiments, at least one Z1c is conjugated to a free amine side chain of an amino acid that has been replaced, inserted, or mutated on an insulin.

In some embodiments, the compound is covalently conjugated either directly or via a linker to a molecule that can bind to at least one protein present in human plasma.

In some embodiments, in each of Formulae F2, F5, and F10 one $R_1$ is (C=O)---*.

In some embodiments, a compound is represented by Formula II, or a stereoisomer or a mixture of stereoisomers, or pharmaceutically acceptable salt thereof:

Z1c-Linker (Formula II)

wherein the Z1c-Linker is selected from:
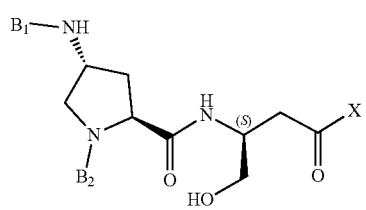
FFL-1
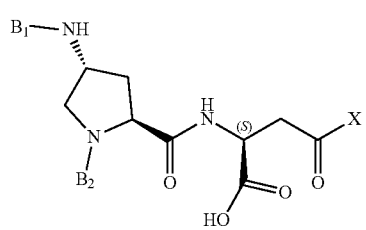
FFL-2
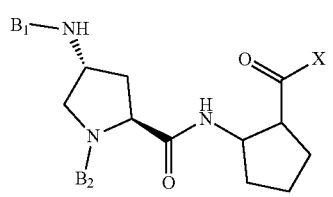
FFL-3
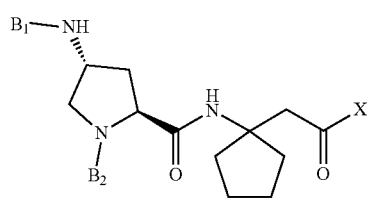
FFL-4
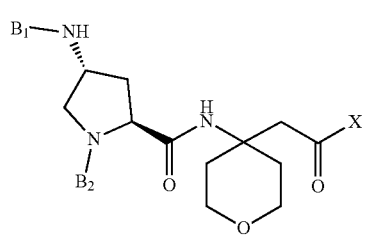
FFL-5
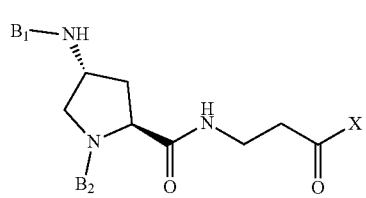
FFL-6
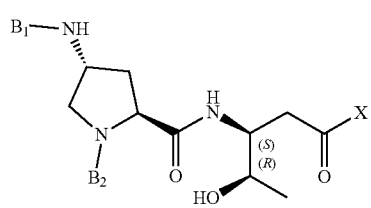
FFL-7
-continued
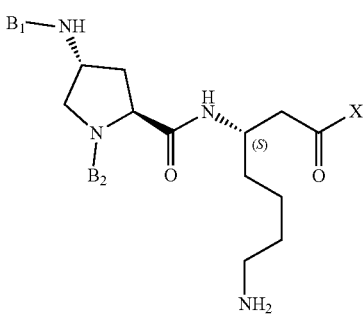
FFL-8
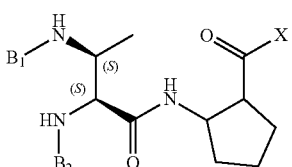
FFL-9
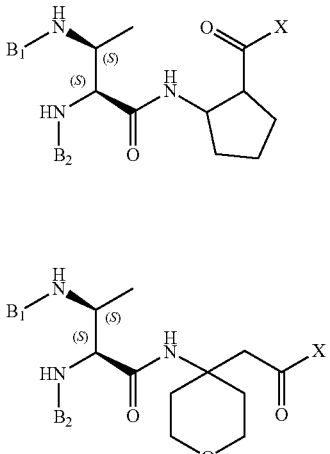
FFL-10
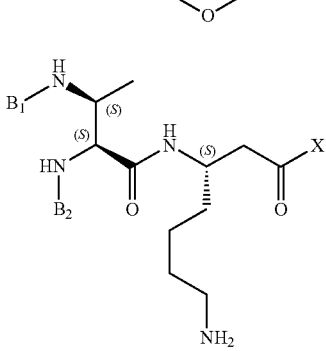
FFL-11
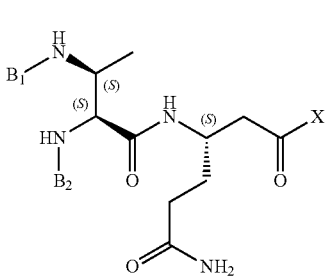
FFL-12
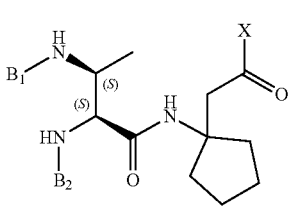
FFL-13

-continued
FFL-14
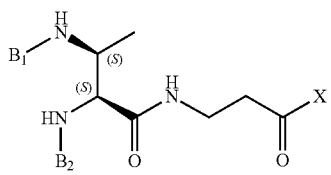
FFL-15
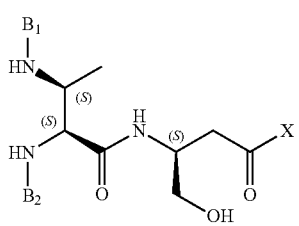
FFL-16
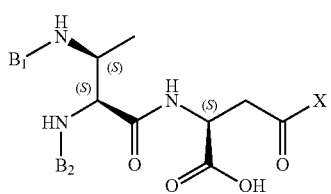
FFL-17
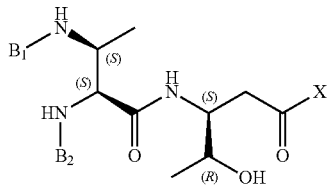
FFL-18
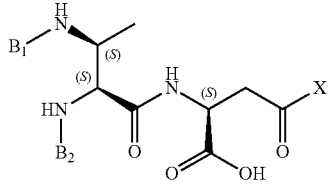
FFL-19
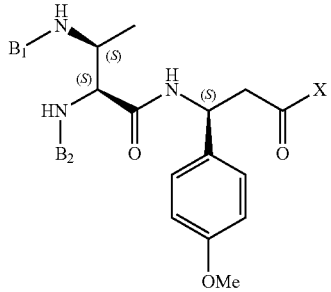
FFL-20
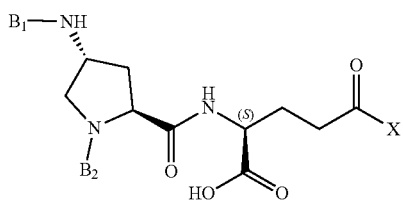
-continued
FFL-21
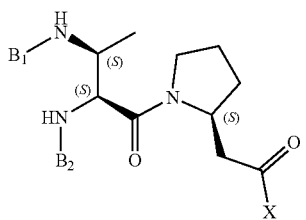
FFL-22
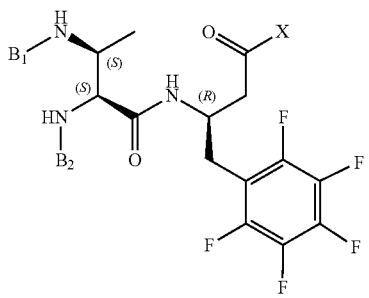
FFL-23
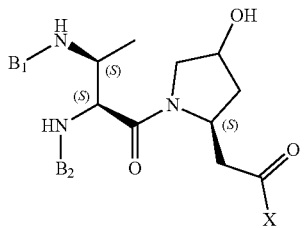
FFL-24
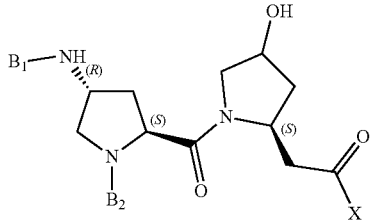
FFL-25
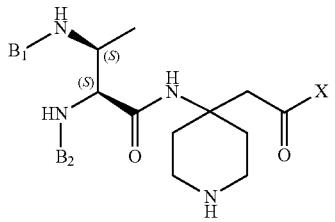
FFL-26
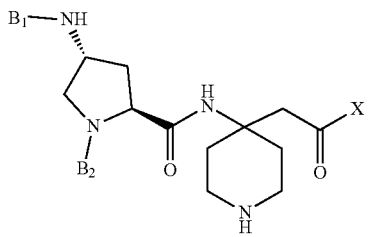
FFL-27
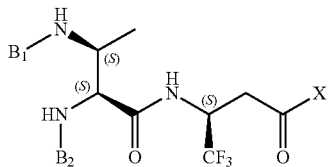

FFL-28
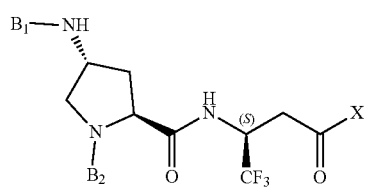
FFL-29
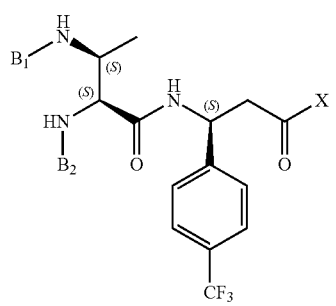
FFL-30
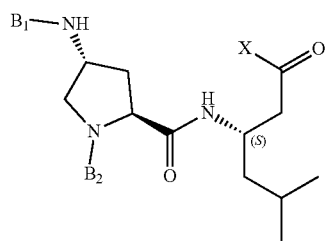
FFL-31
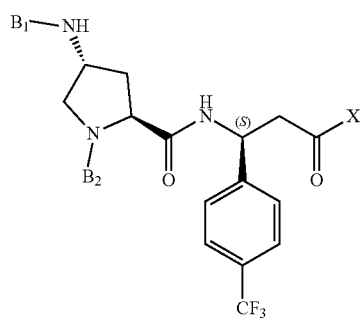
FFL-32
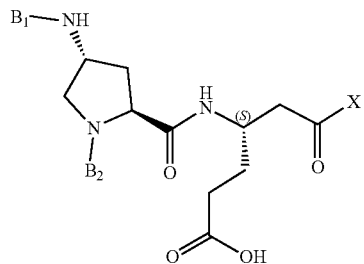
FFL-33
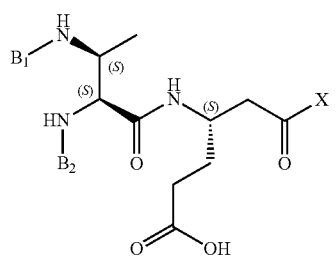
FFL-34
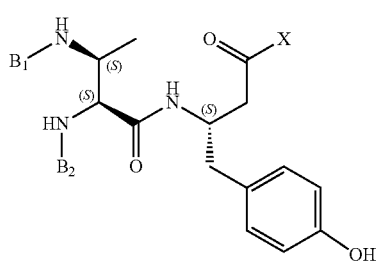
FFL-35
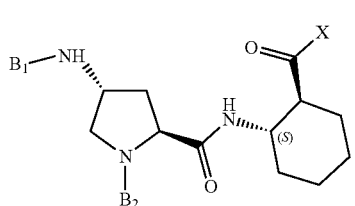
FFL-36
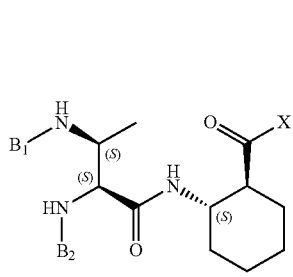
FFL-37
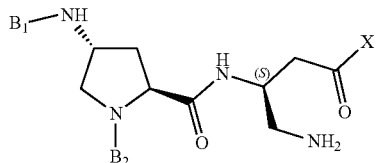
FFL-38
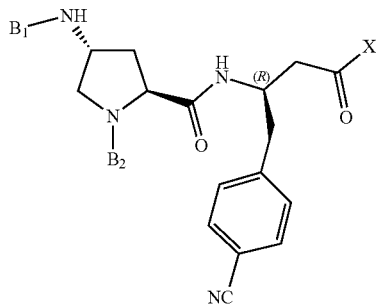
FFL-39
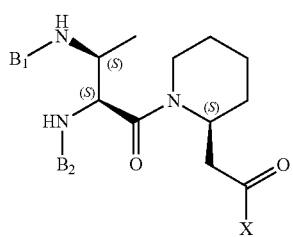

FFL-40
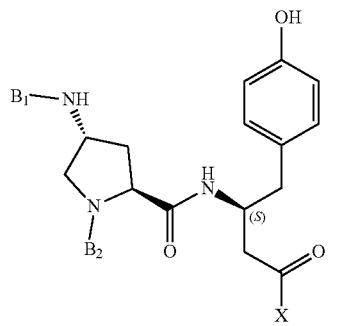
FFL-41
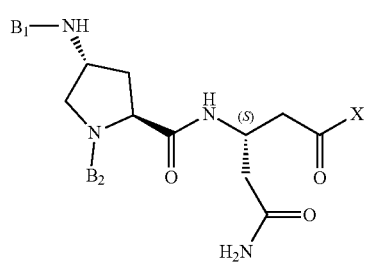
FFL-42
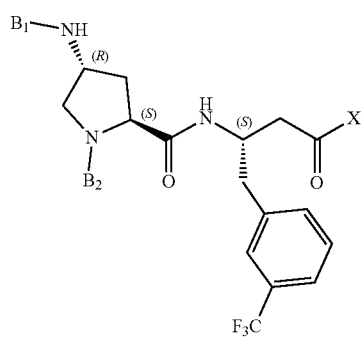
FFL-43
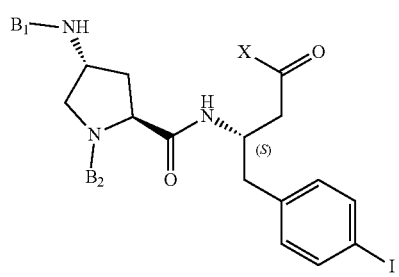
FFL-44
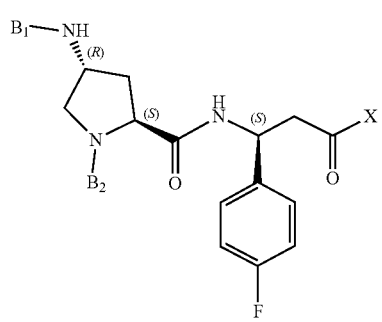
FFL-45
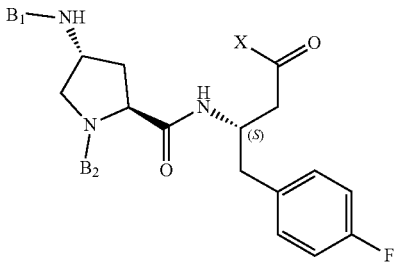
FFL-46
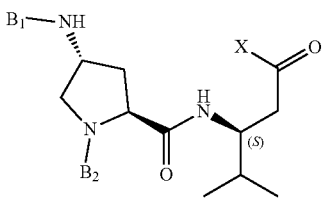
FFL-47
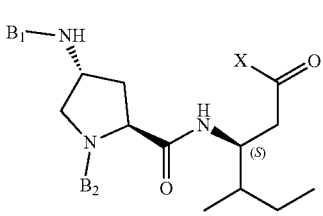
FFL-48
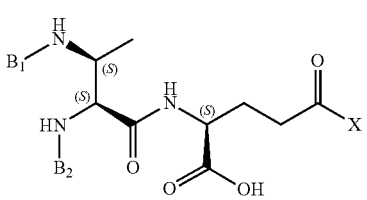
FFL-49
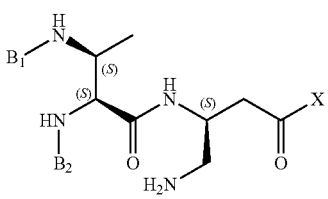
FFL-50
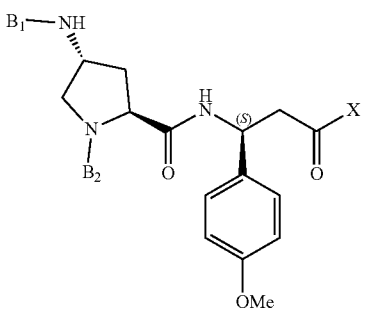
FFL-51
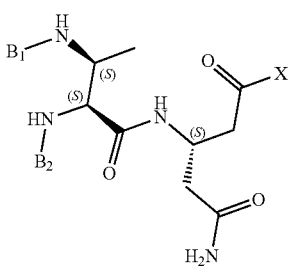

FFL-52
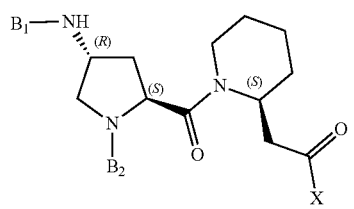
FFL-53
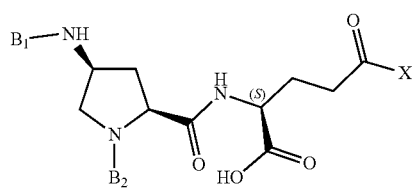
FFL-54
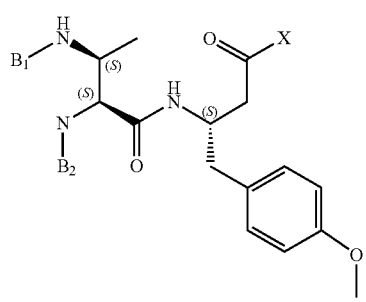
FFL-55
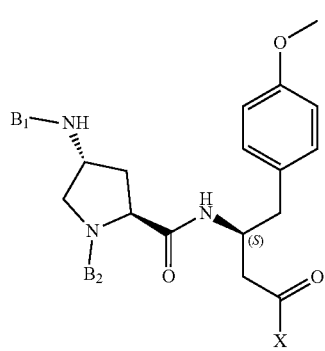
FFL-56
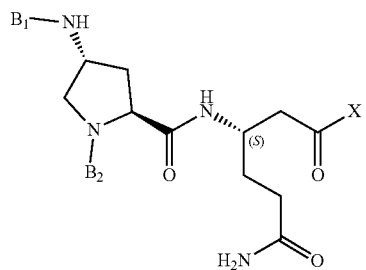
FFL-57
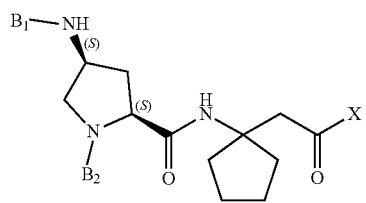
FFL-58
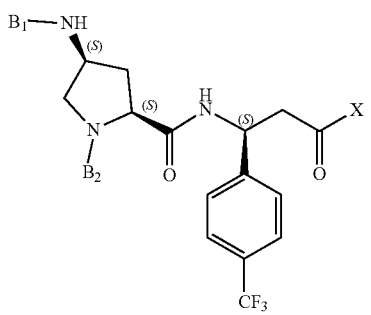
FFL-59
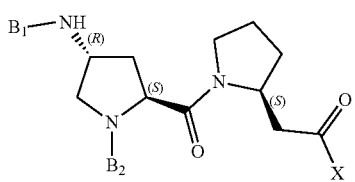
FFL-60
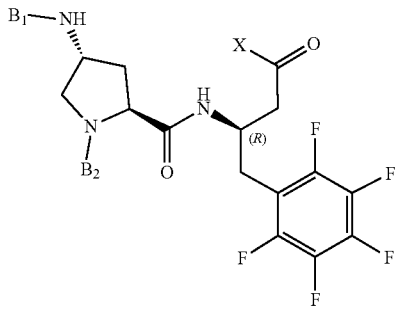
FFL-61
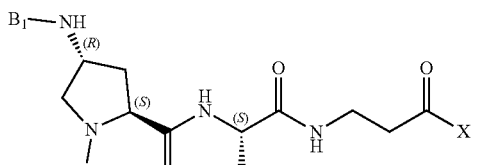
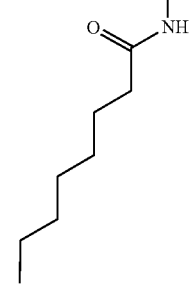

FFL-62
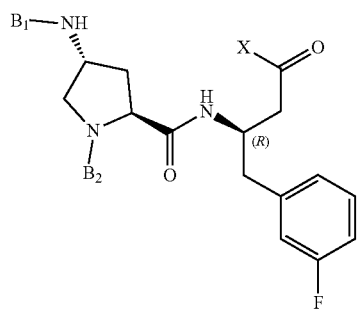
FFL-63
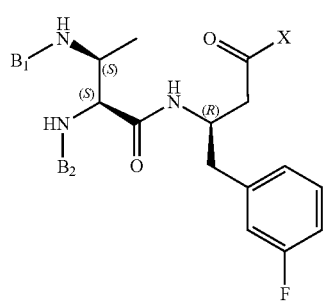
FFL-64
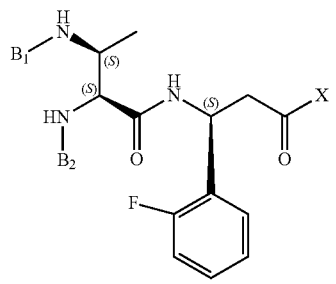
FFL-65
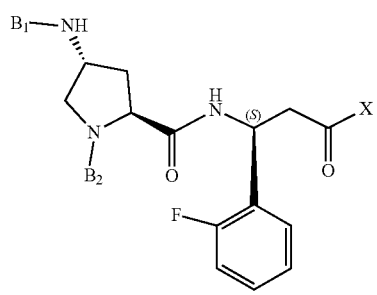
FFL-66
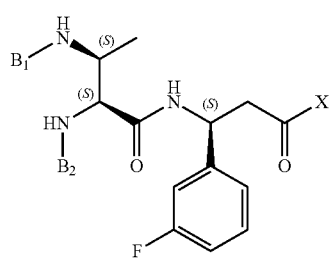
FFL-67
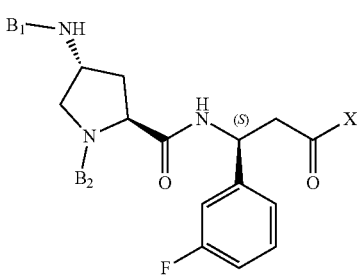
FFL-68
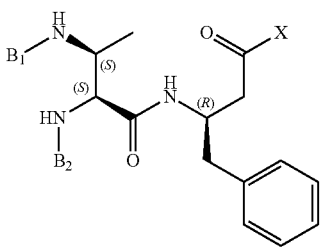
FFL-69
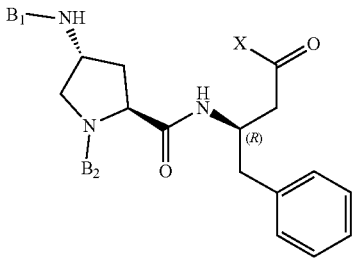
FFL-70
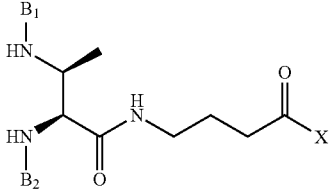
FFL-71
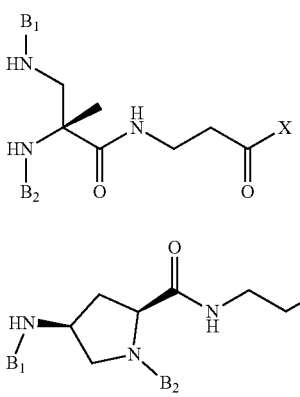
FFL-72
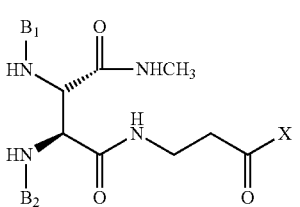
FFL-73

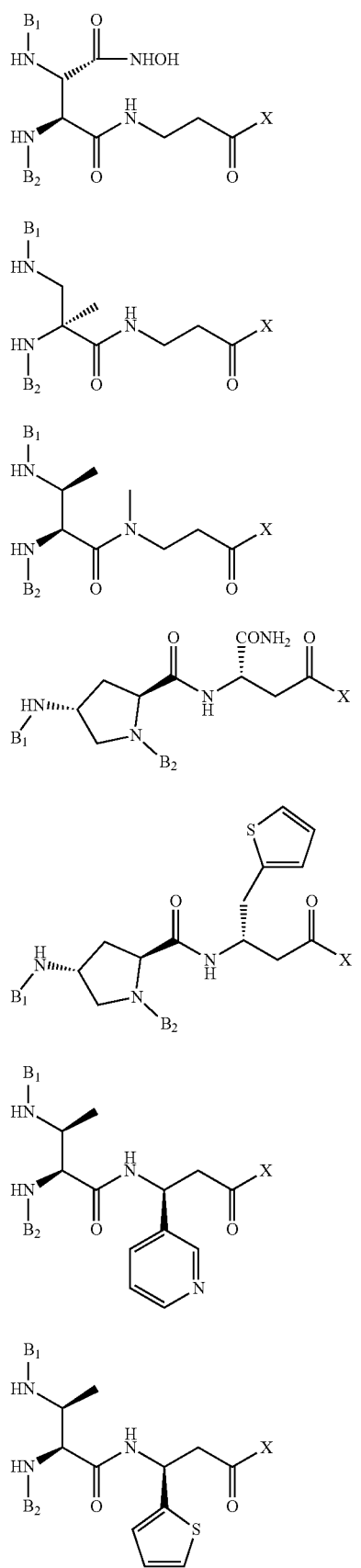
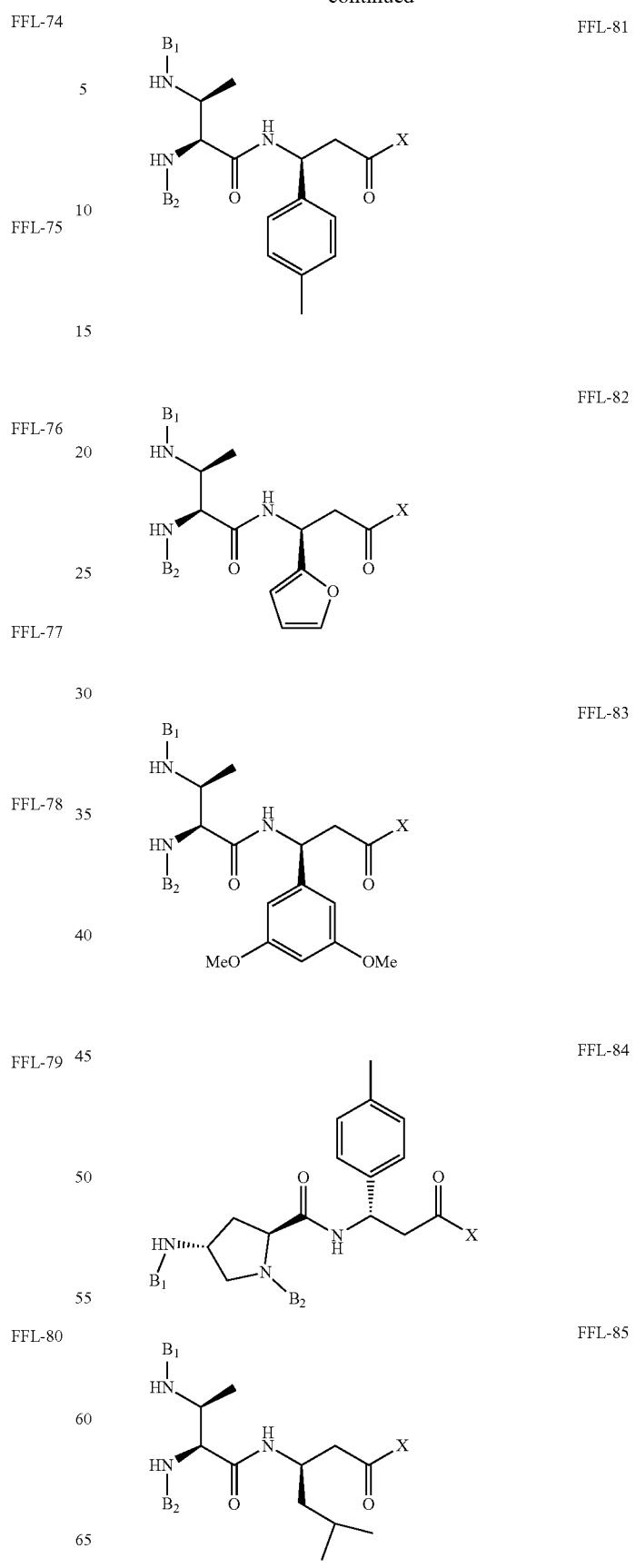

-continued
FFL-86
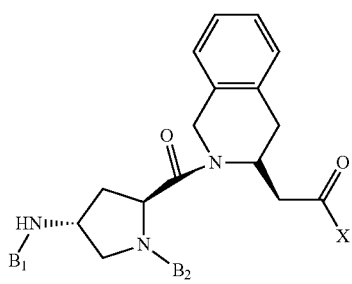
FFL-87
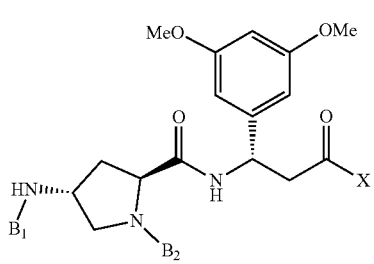
FFL-88
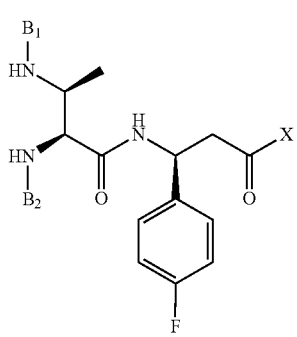
FFL-89
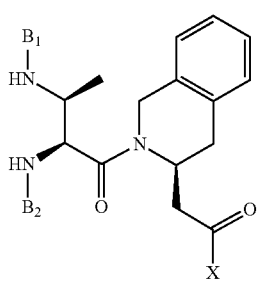
FFL-90
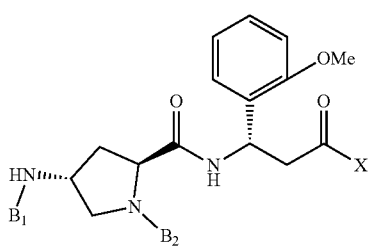
-continued
FFL-91
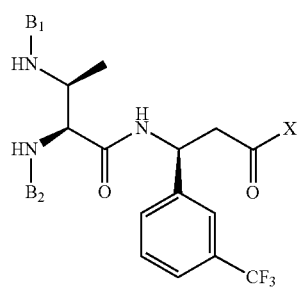
FFL-92
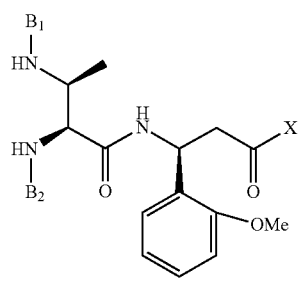
FFL-93
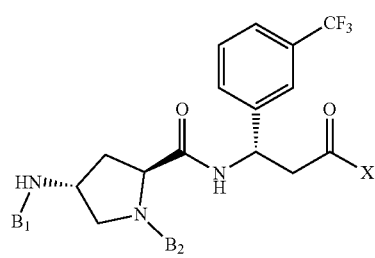
FFL-94
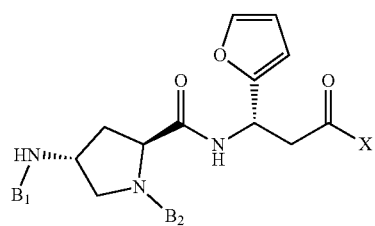
FFL-95
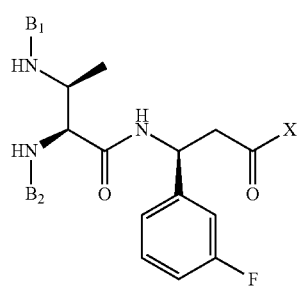
FFL-96

-continued

FFL-97
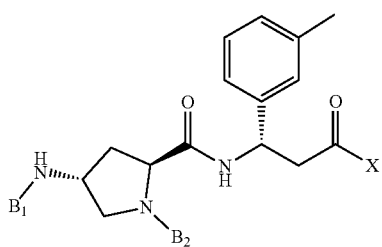

FFL-98
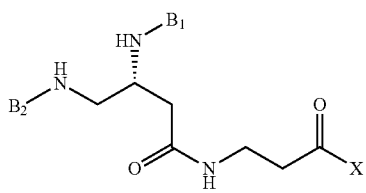

FFL-99
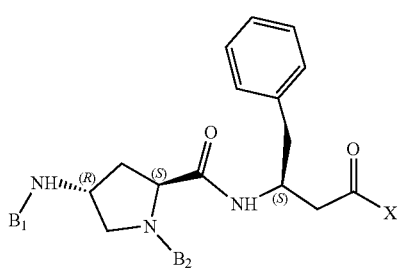

FFL-100
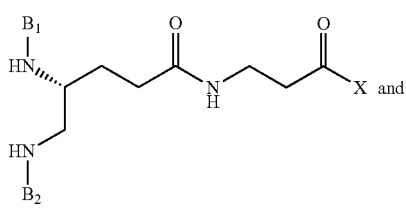
and

FFL-101
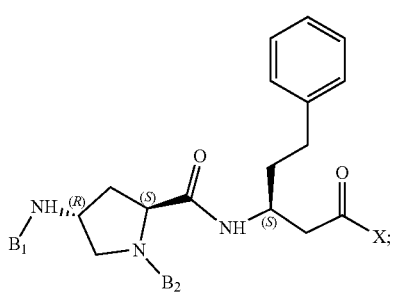

wherein X is selected from a leaving group, $NH_2$, OH, and H; and $B_1$ and $B_2$, which may be identical or different, each independently represents an aromatic boron-containing group.

In some embodiments, the compound represented by Formula (II) comprises at least one $B_1$ or $B_2$ independently selected from Formulae F2, F5, and F10, wherein Formulae F2, F5, and F10 are:

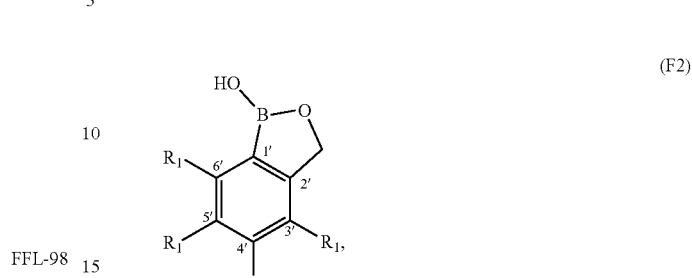
(F2)

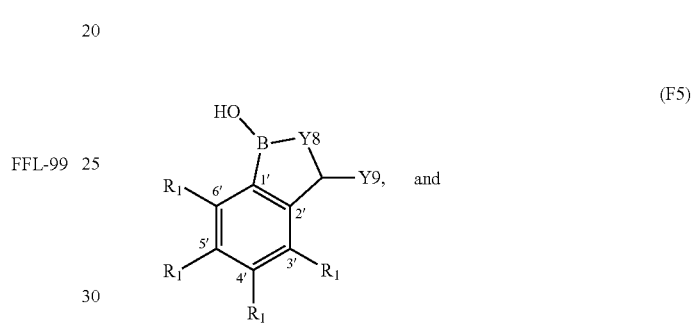
(F5)
and

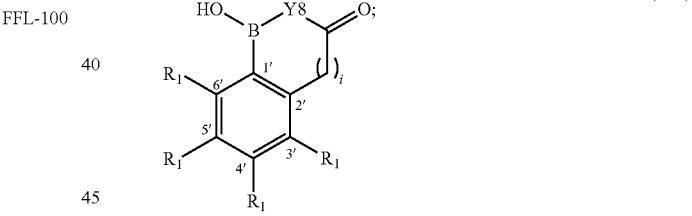
(F10)

wherein:

one $R_1$ represents (C=O)---* or $(CH_2)_m$(C=O)---*, wherein ---* represents the attachment point to the rest of Z1c, and m is 1, 2, 3, 4, 5, 6, or 7; and each remaining $R_1$ is independently selected from H, F, Cl, Br, I, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_{m''}CH_3$, $(SO_2)NH$—$CH_3$, $(SO_2)NH(CH_2)_{m''}CH_3$, and $OCF_3$, wherein m" is 1, 2, 3, 4, 5, 6, or 7;

Y8 is O, N, and NR, wherein R is an alkyl group (e.g., $C_1$-$C_6$ alkyl group) or H;

Y9 is H, $CH_3$, or an alkyl group (e.g., $C_1$-$C_6$ alkyl group), provided that when Y8 is O, the Y9 is a $CH_3$ or an alkyl group (e.g., $C_1$-$C_6$ alkyl group); and i is 1, 2, or 3.

In some embodiments, the Z1c-Linker (i.e., Formula II) is selected from:

DSL-1
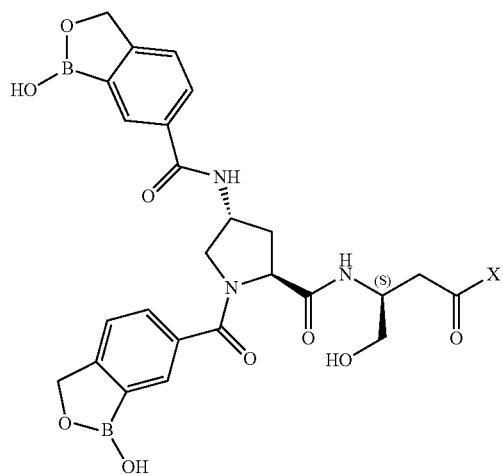
DSL-2
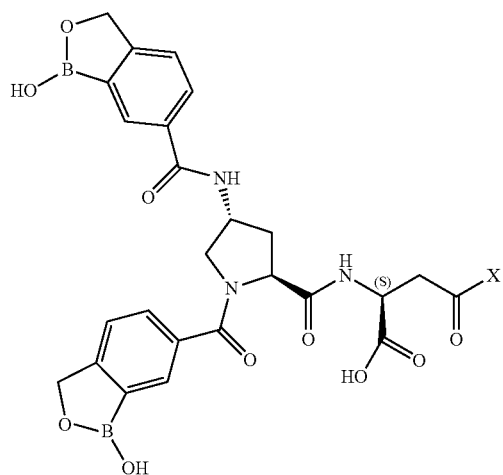
DSL-3
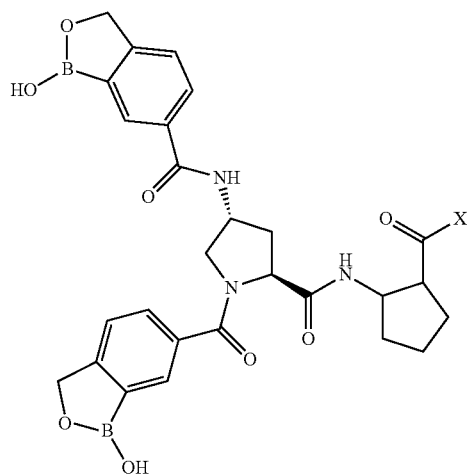
-continued
DSL-4
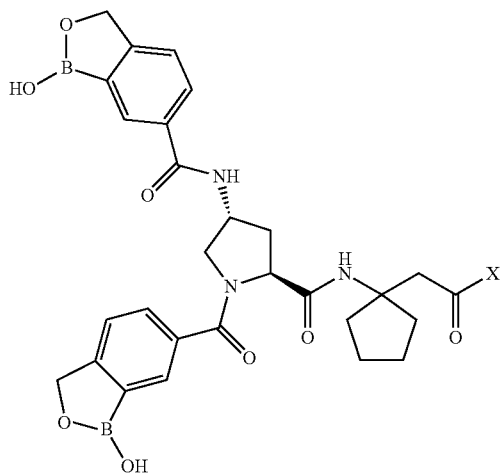
DSL-5
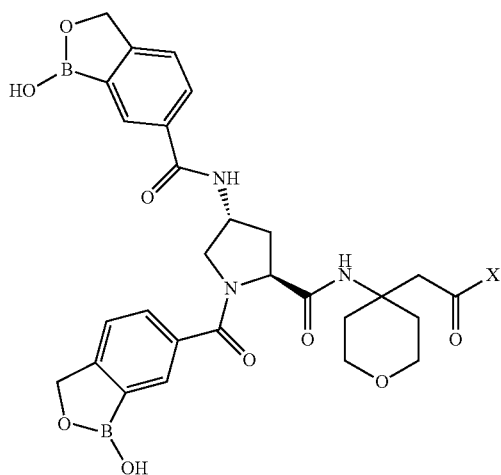
DSL-6
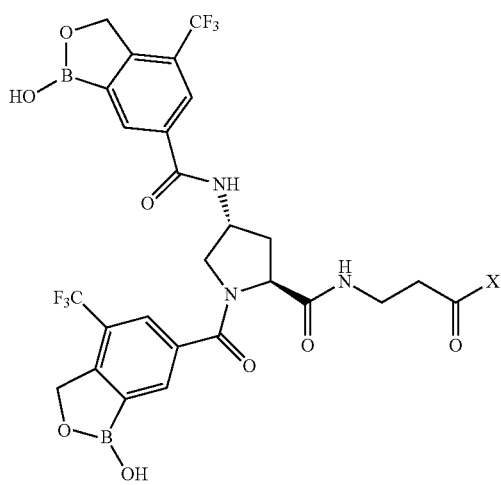

DSL-7
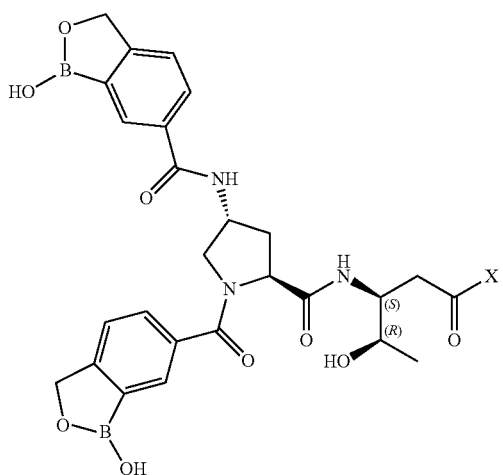
DSL-8
DSL-9
DSL-10
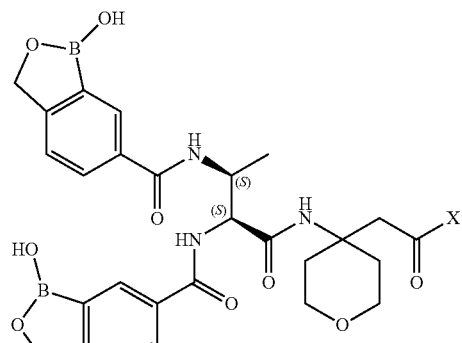
DSL-11
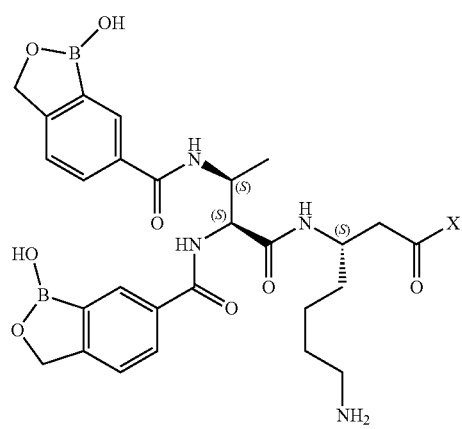
DSL-12
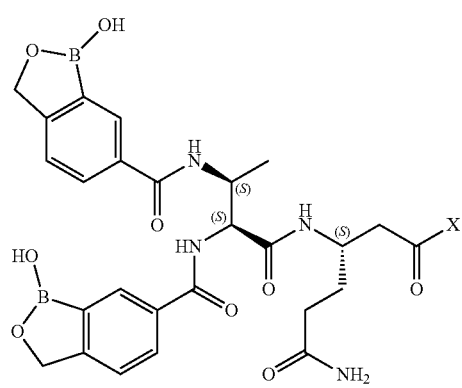
DSL-13
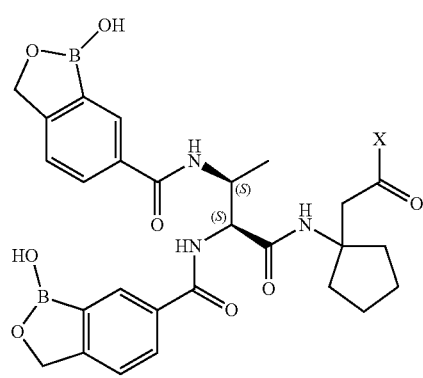

DSL-14
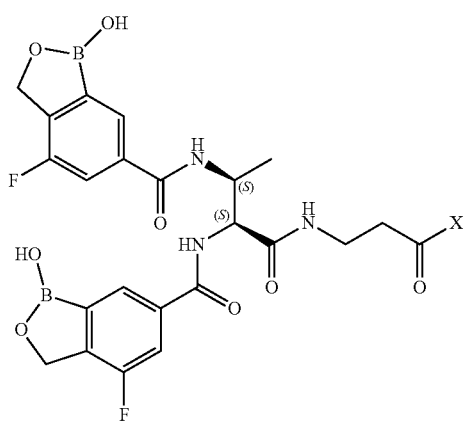
DSL-15
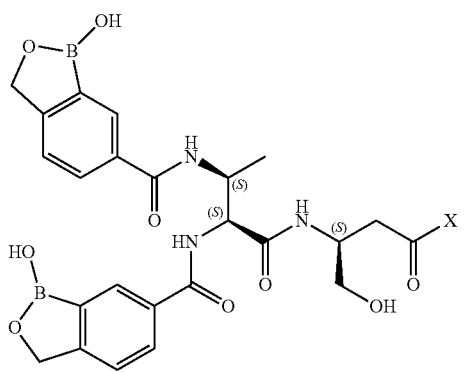
DSL-16
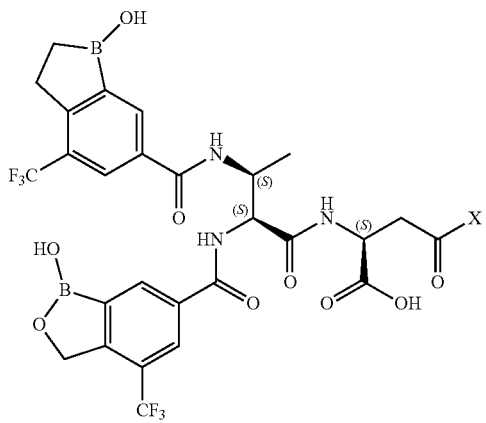
DSL-17
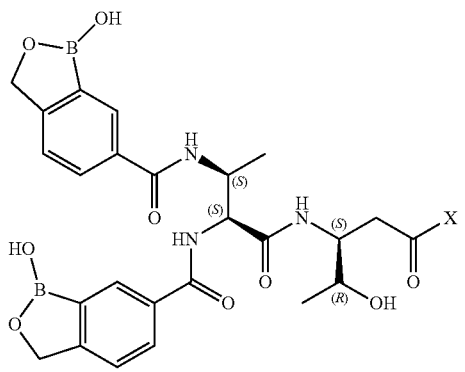
DSL-18
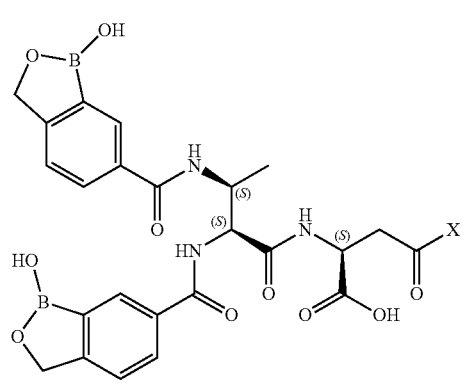
DSL-19
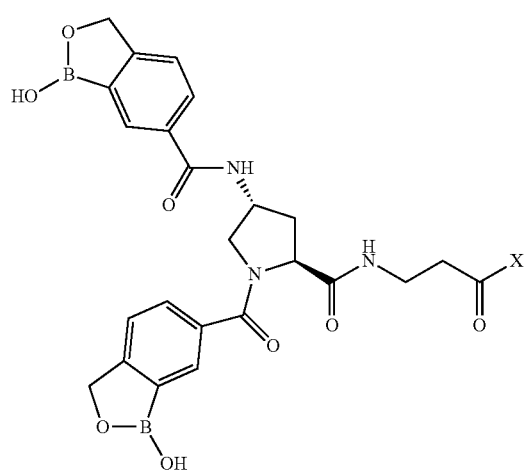
DSL-20
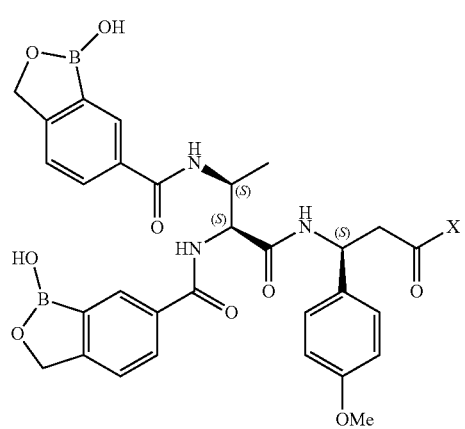

DSL-21
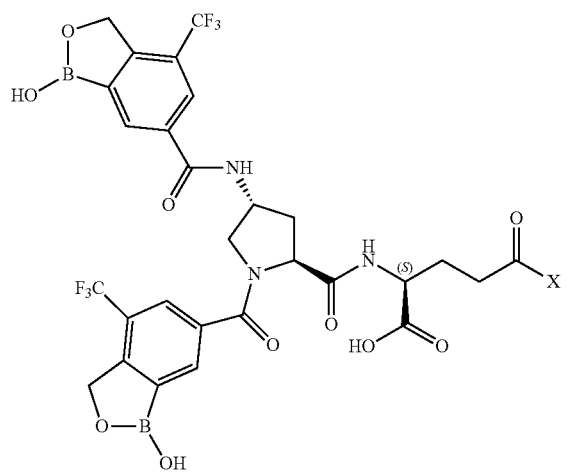
DSL-22
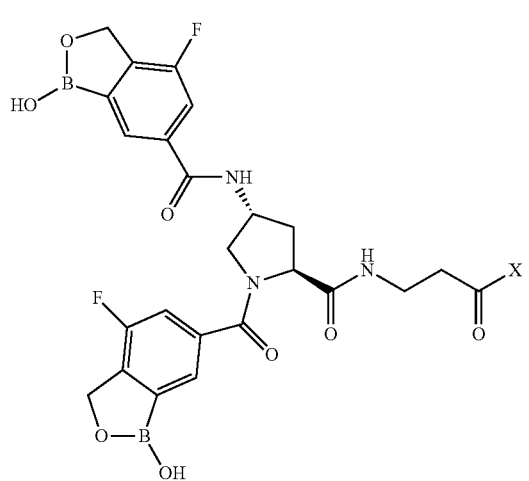
DSL-23
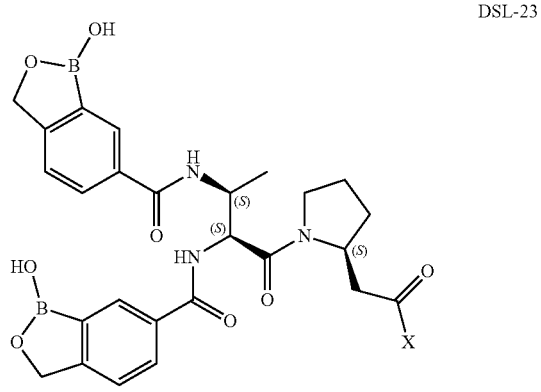
DSL-24
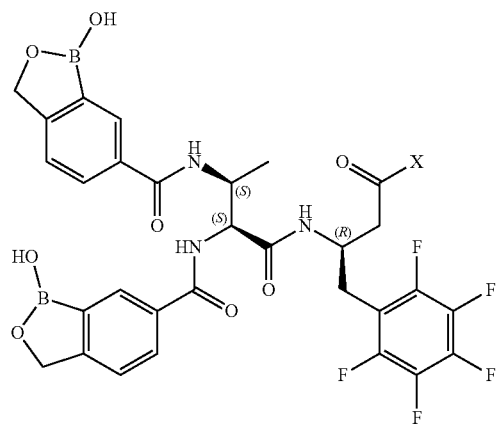
DSL-25
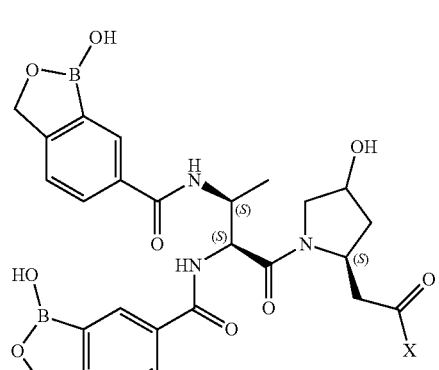
DSL-26
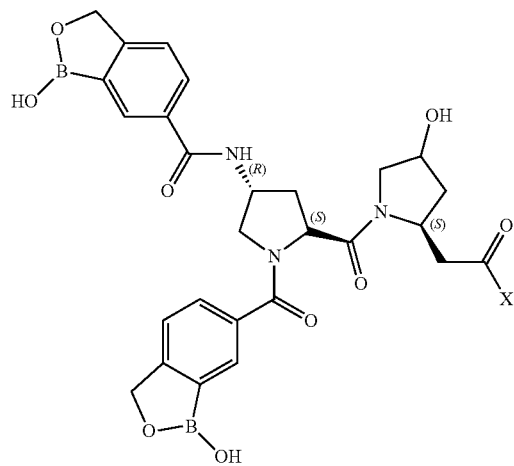

DSL-27
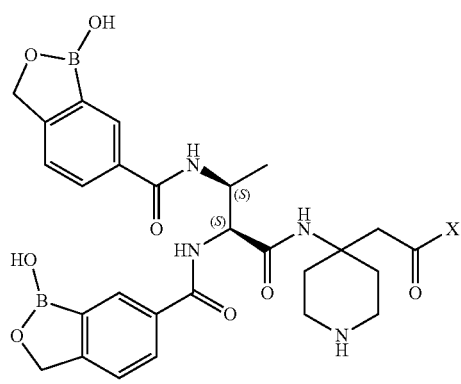
DSL-28
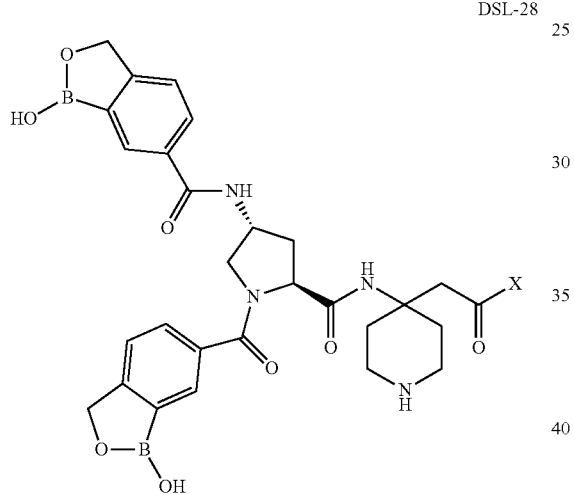
DSL-29
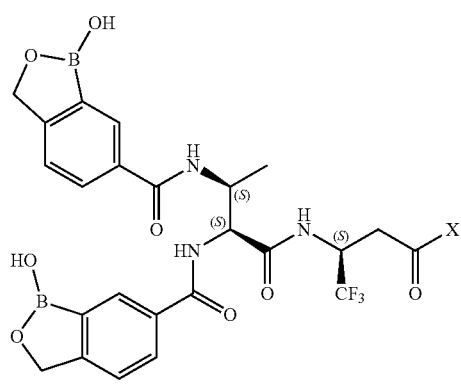
DSL-30
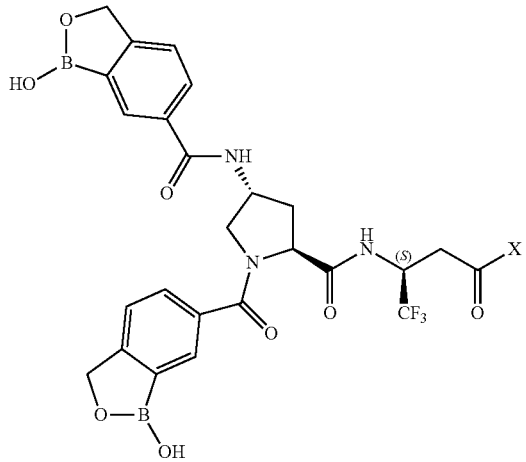
DSL-31
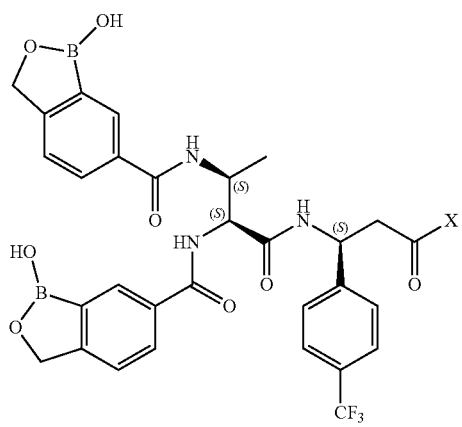
DSL-32
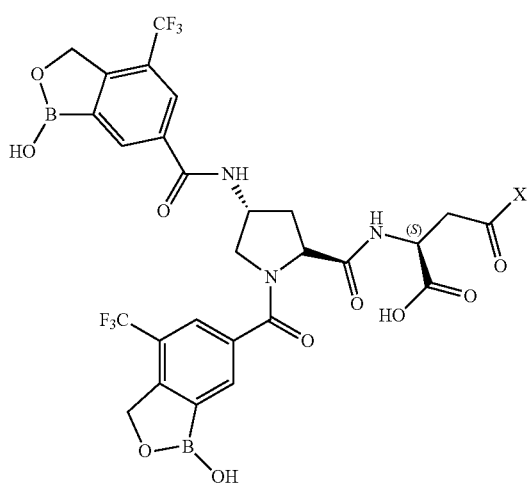

-continued
DSL-33
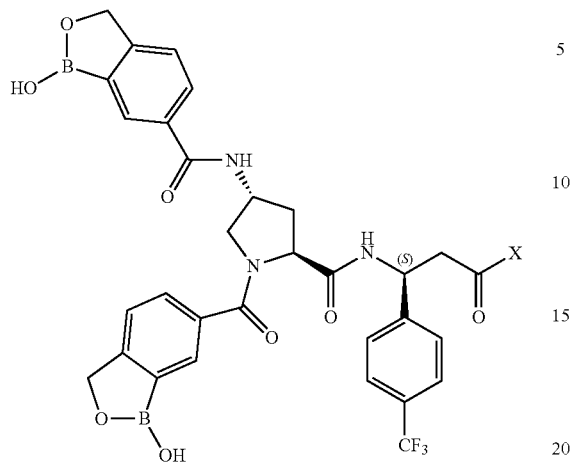
DSL-36
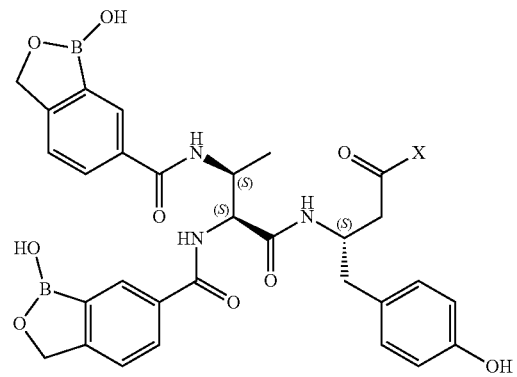
DSL-34
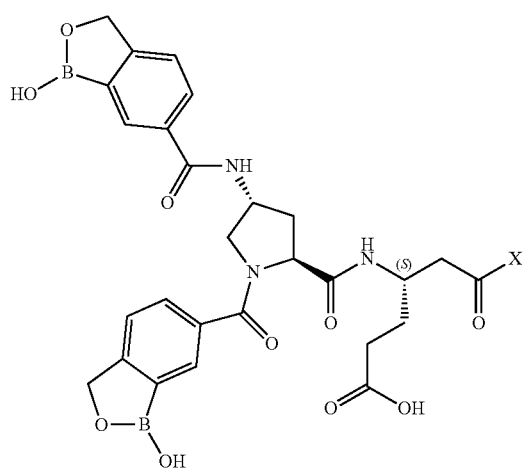
DSL-37
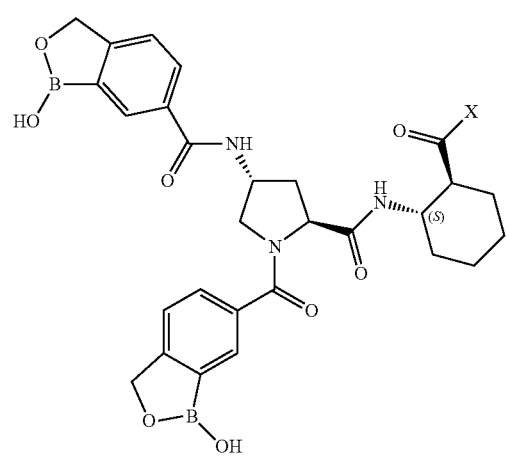
DSL-35
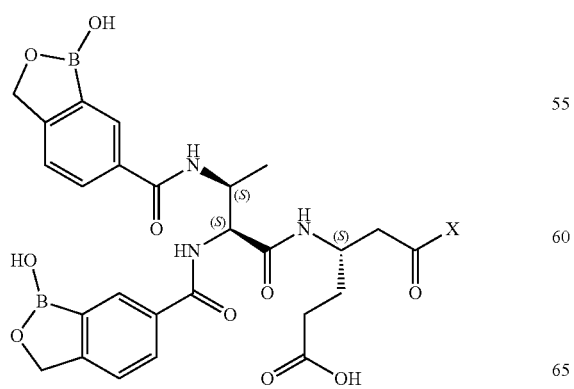
DSL-38
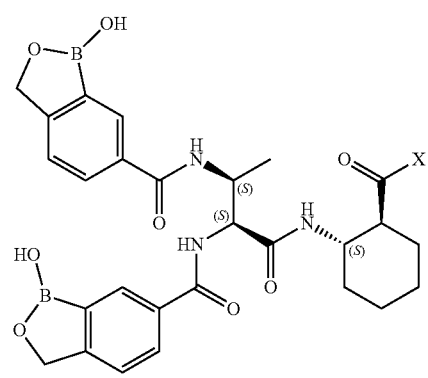

-continued
DSL-39
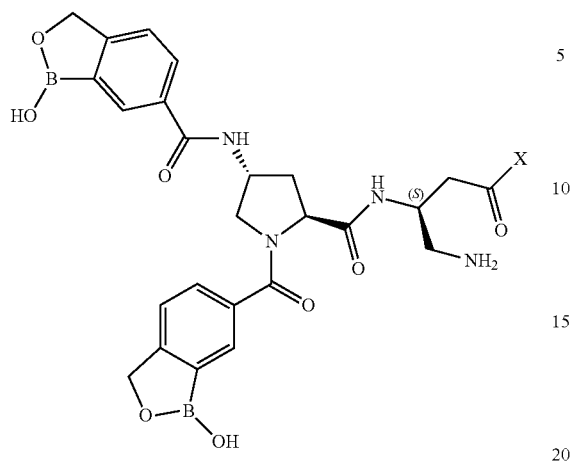
DSL-42
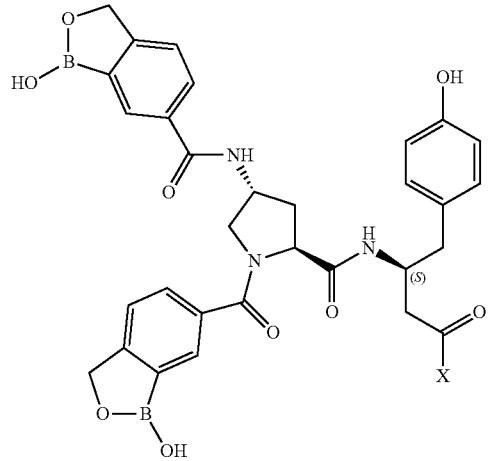
DSL-40
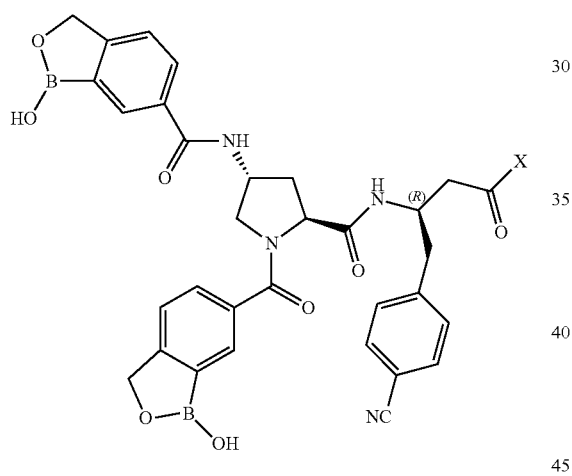
DSL-43
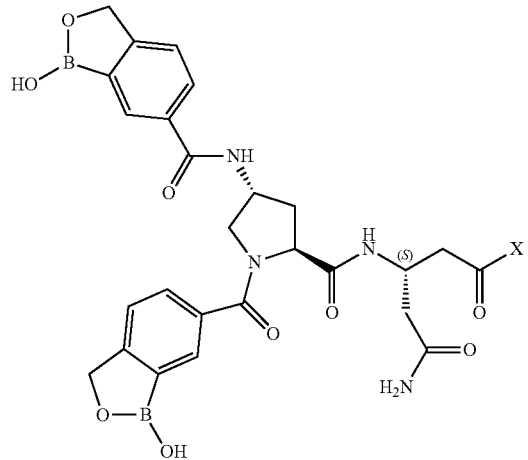
DSL-41
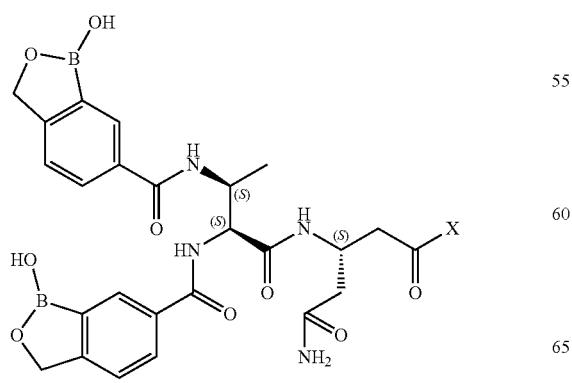
DSL-44
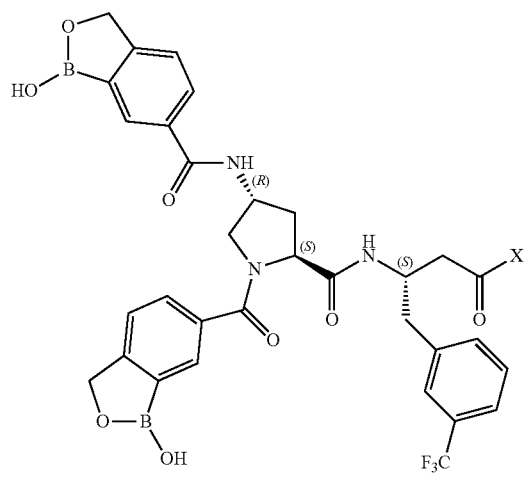

DSL-45
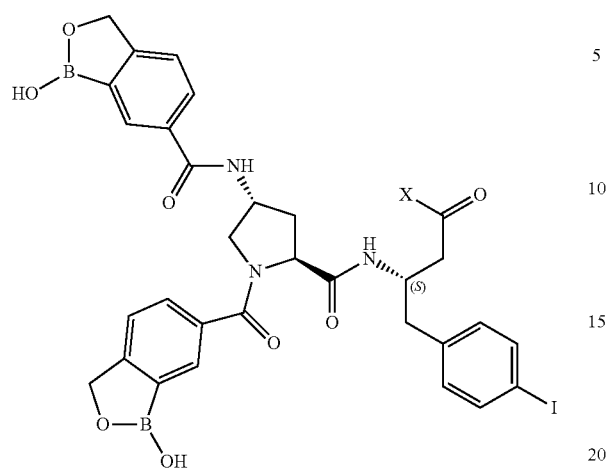
DSL-46
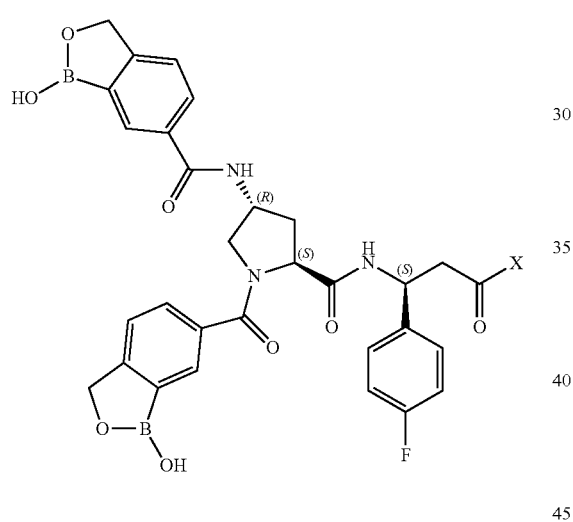
DSL-47
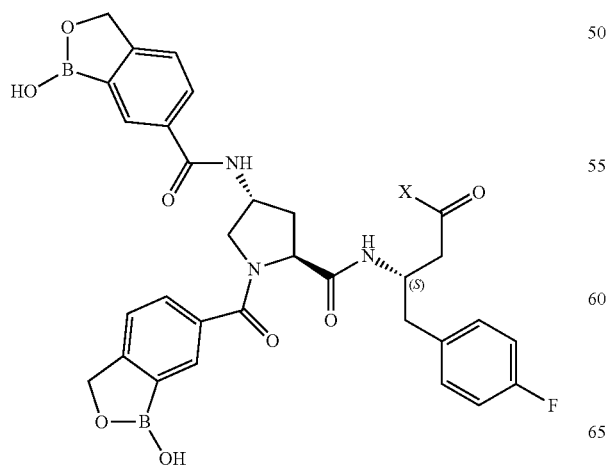
DSL-48
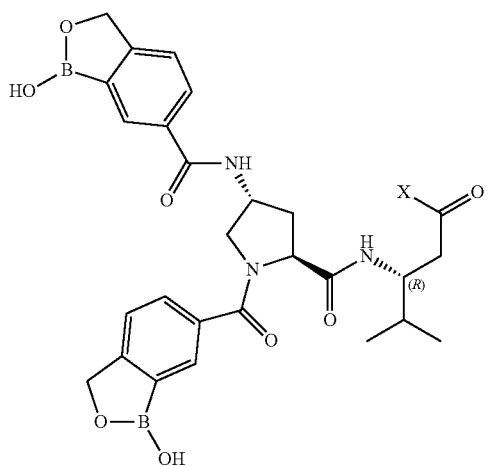
DSL-49
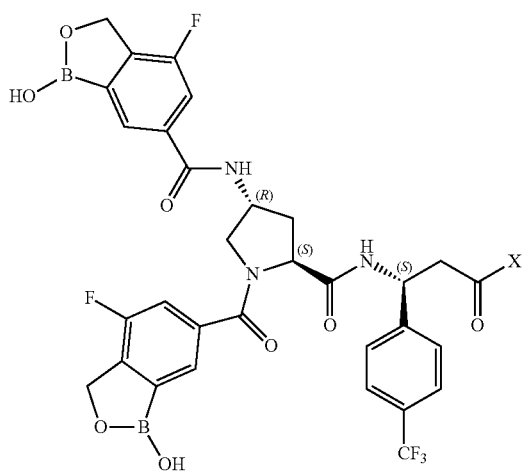
DSL-50
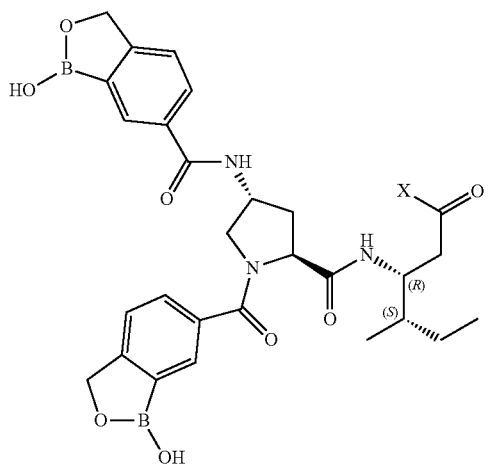

-continued
DSL-51
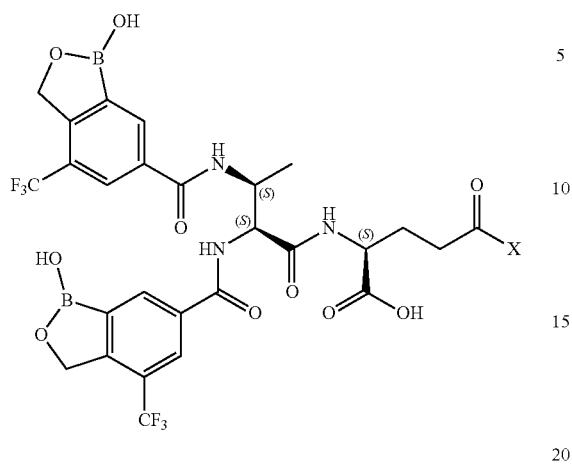
DSL-54
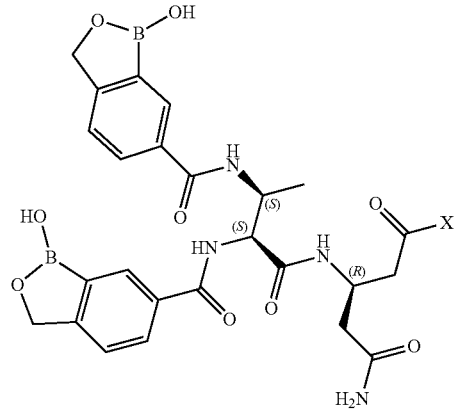
DSL-52
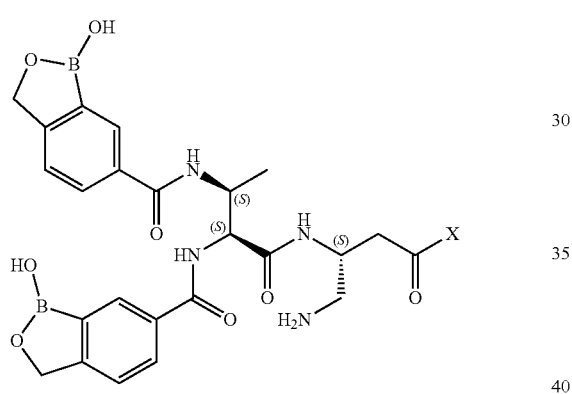
DSL-55
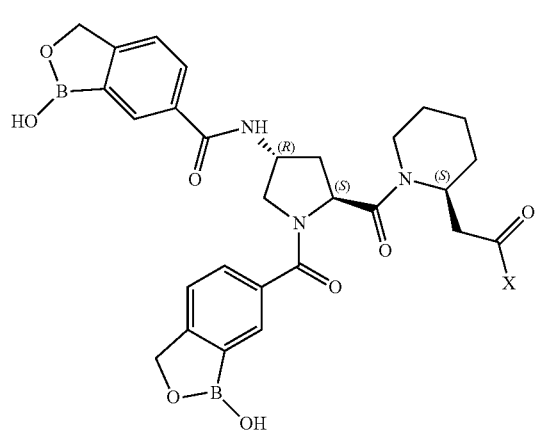
DSL-53
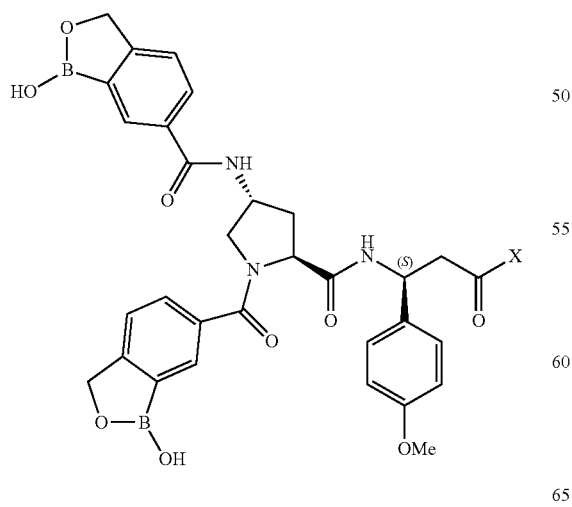
DSL-56
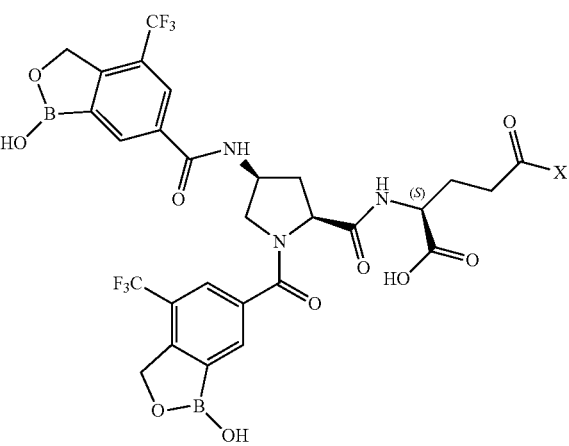

DSL-57
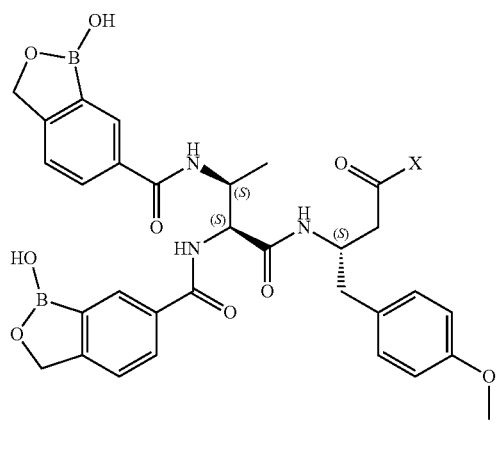
DSL-58
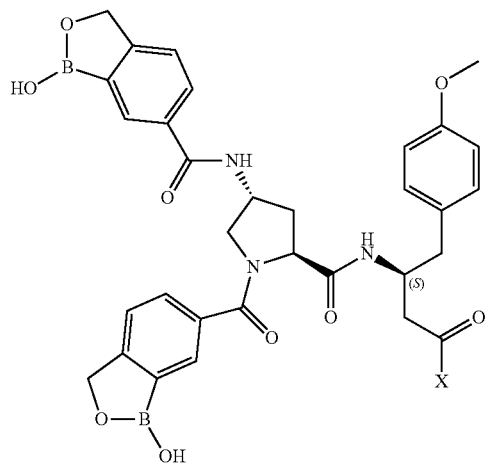
DSL-59
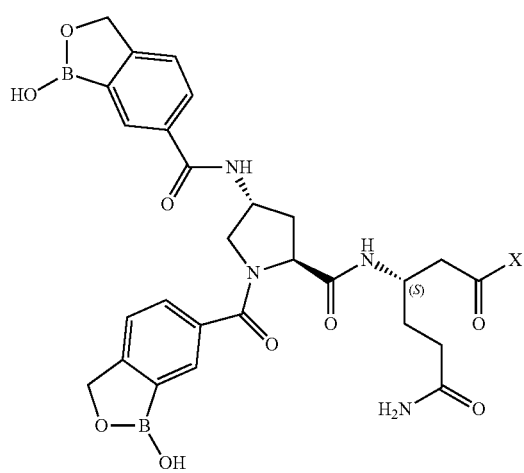
DSL-60
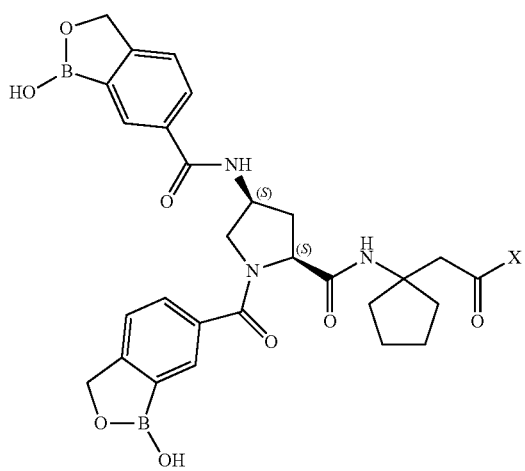
DSL-61
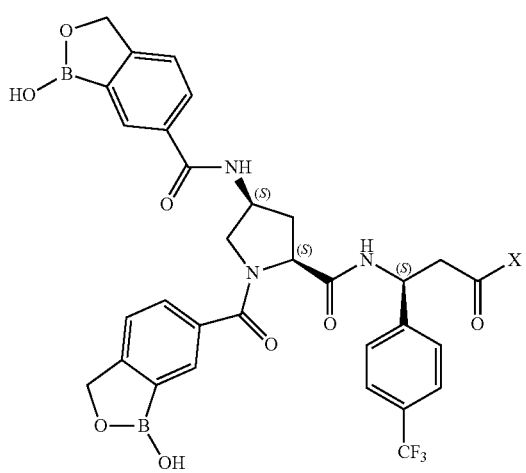
DSL-62
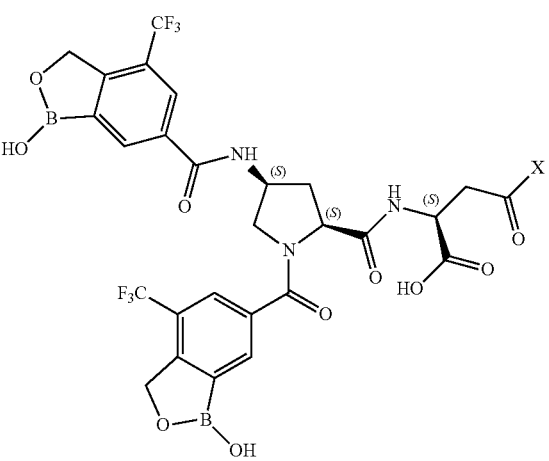

DSL-63
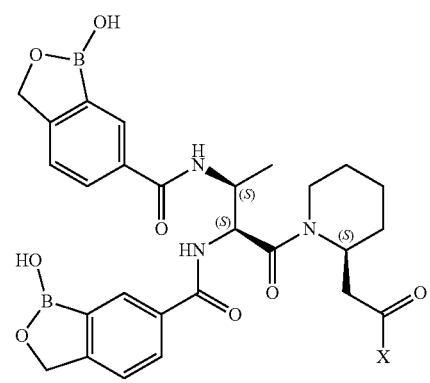
DSL-66
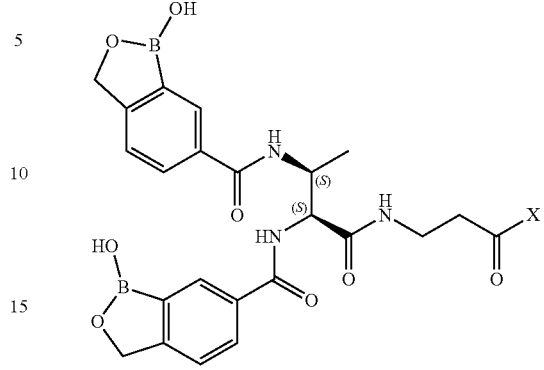
DSL-64
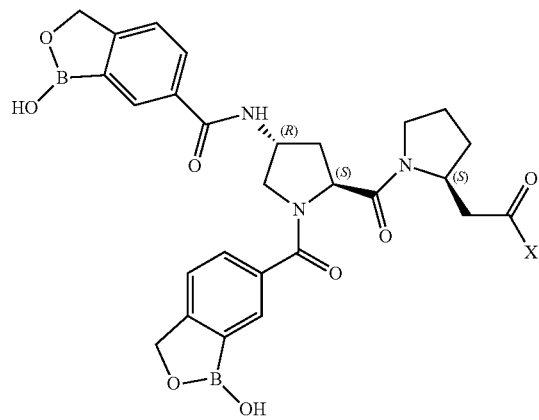
DSL-67
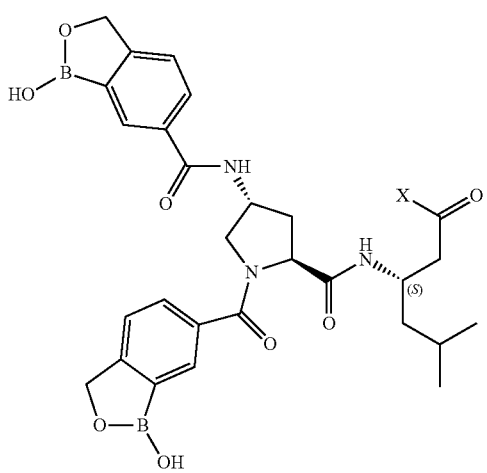
DSL-65
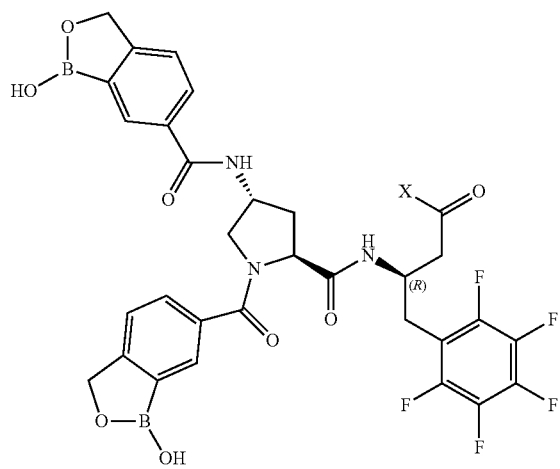
DSL-68
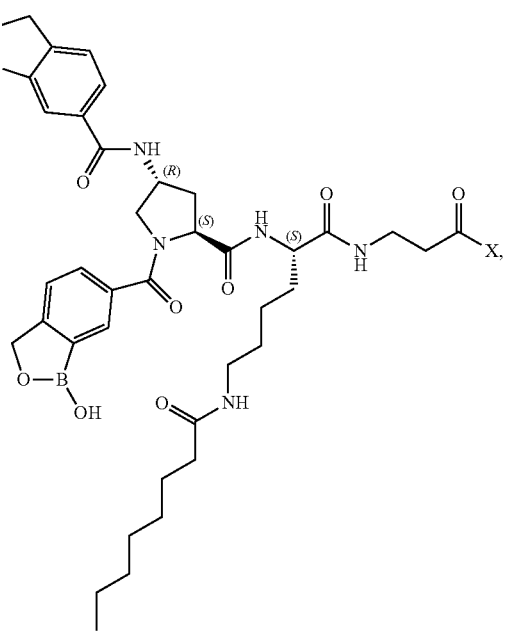

DSL-69
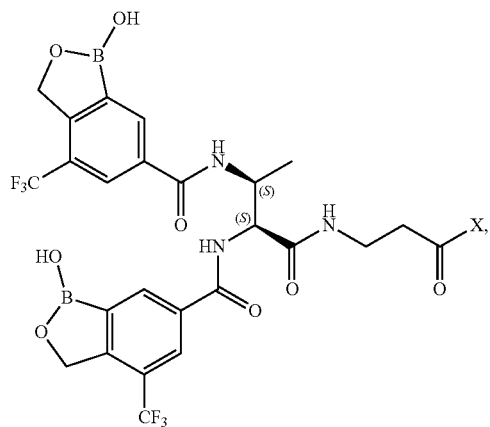
DSL-70
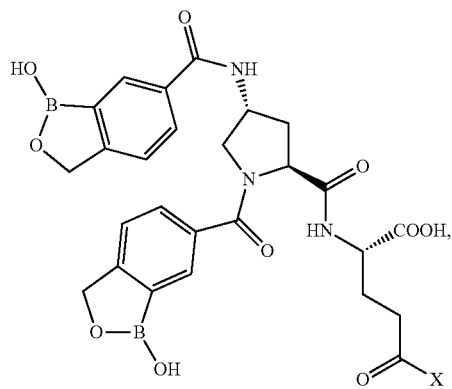
DSL-71
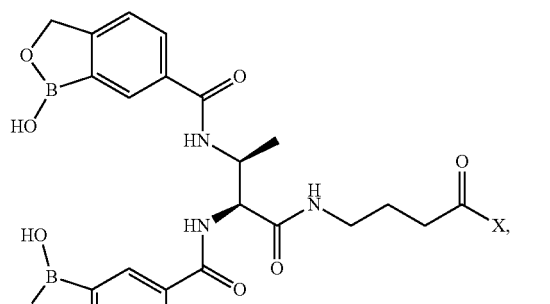
DSL-72
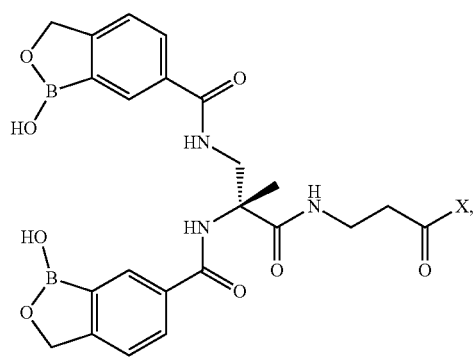
DSL-73
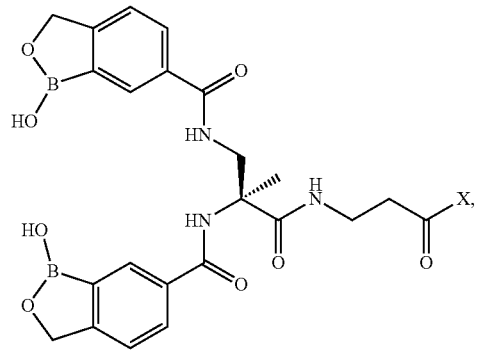
DSL-74
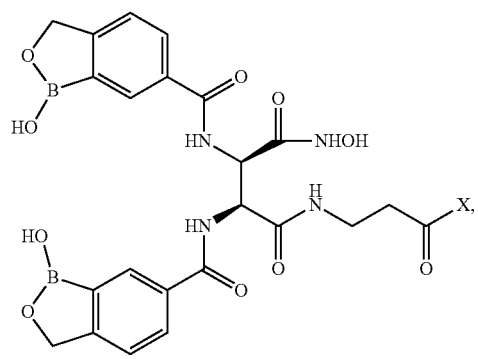
DSL-75
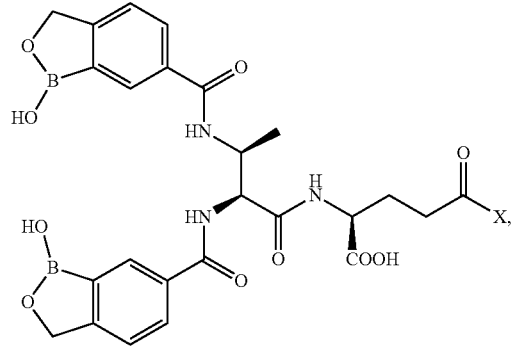
DSL-76
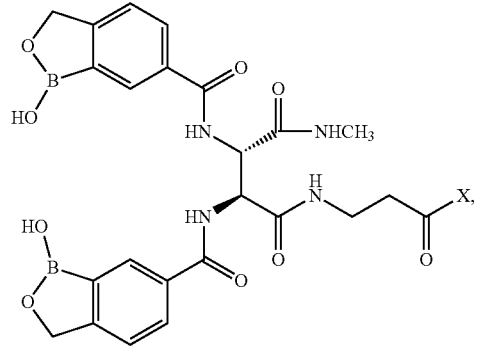

DSL-77
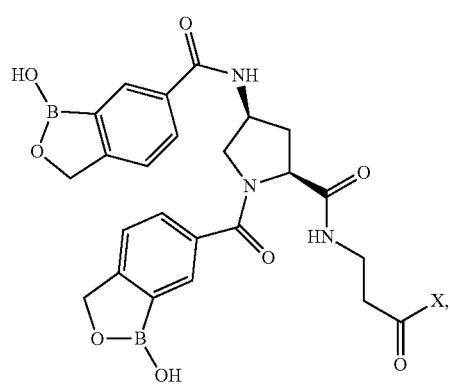
DSL-78
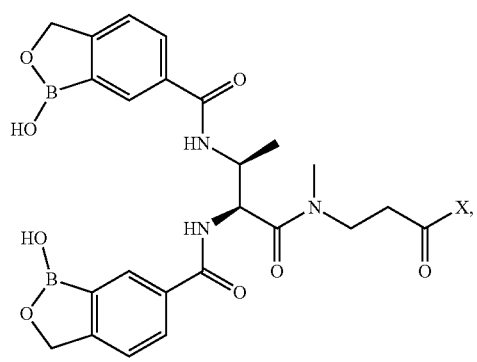
DSL-79
DSL-80
DSL-81
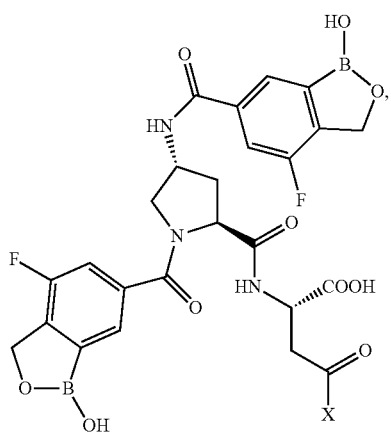
DSL-82
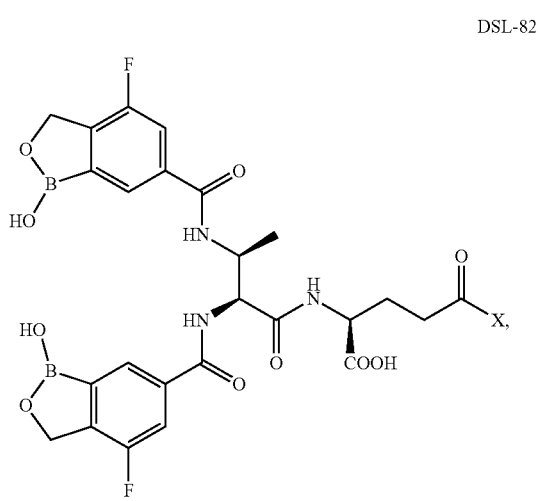
DSL-83
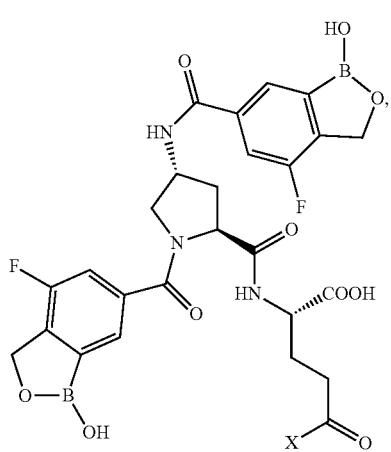

-continued
DSL-84
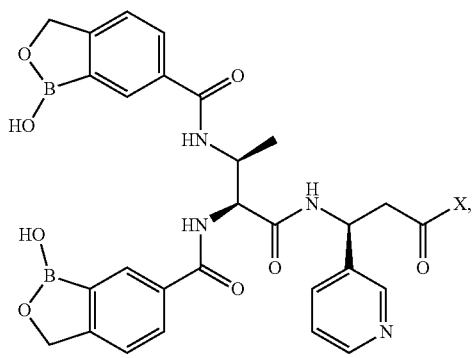
DSL-85
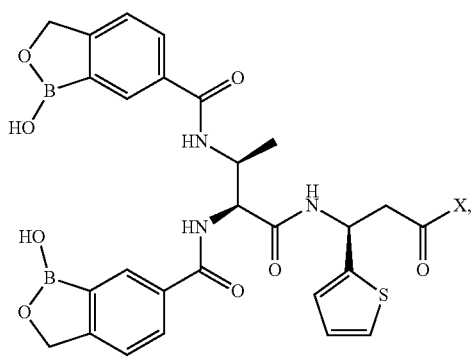
DSL-86
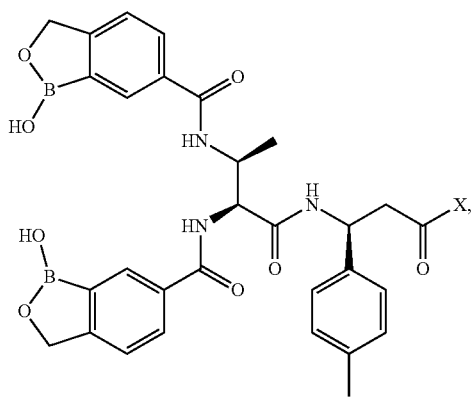
DSL-87
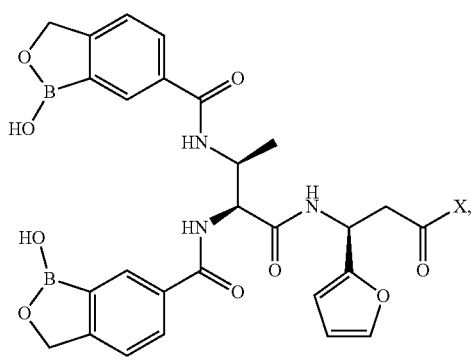
-continued
DSL-88
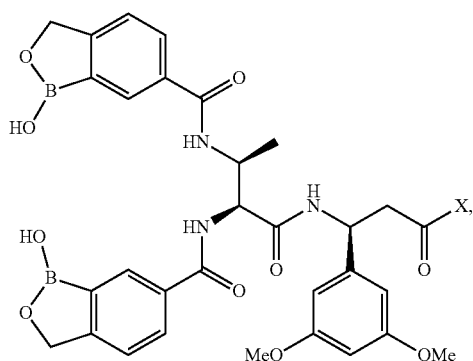
DSL-89
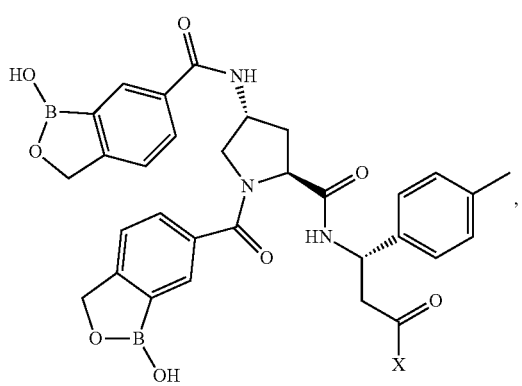
DSL-90
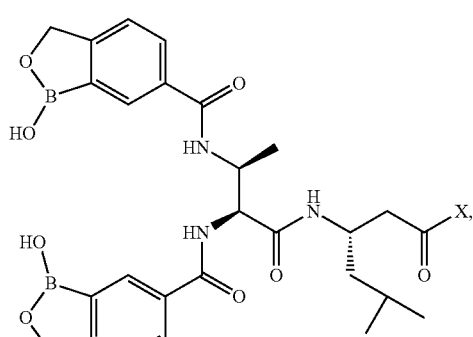
DSL-91
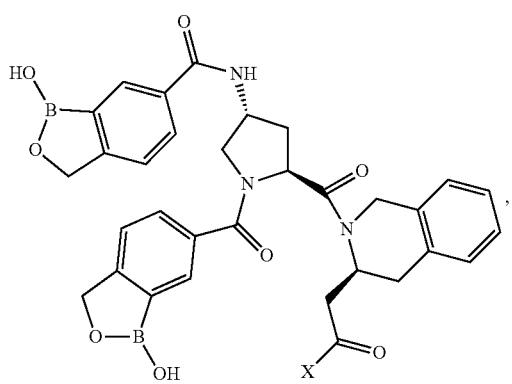

-continued
DSL-92
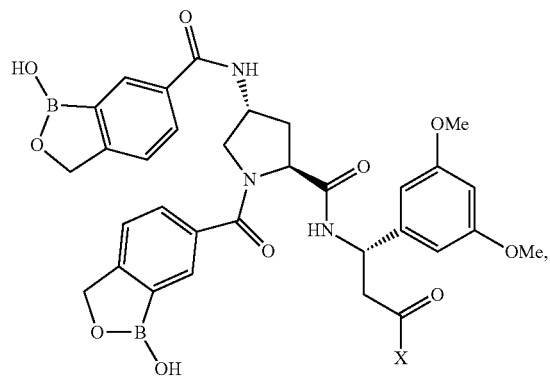
DSL-93
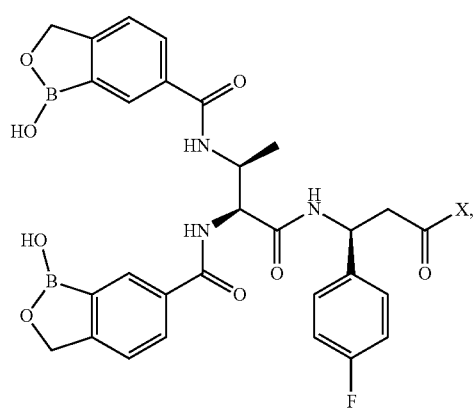
DSL-94
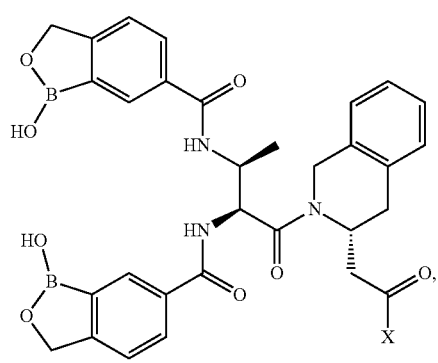
DSL-95
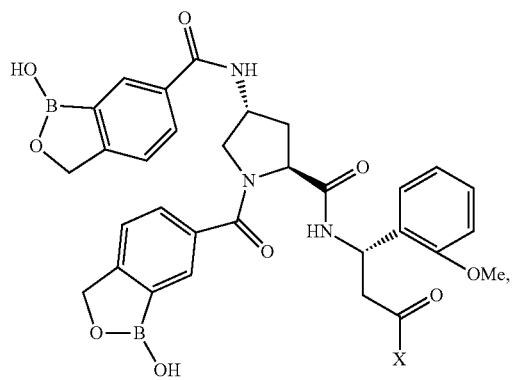
DSL-96
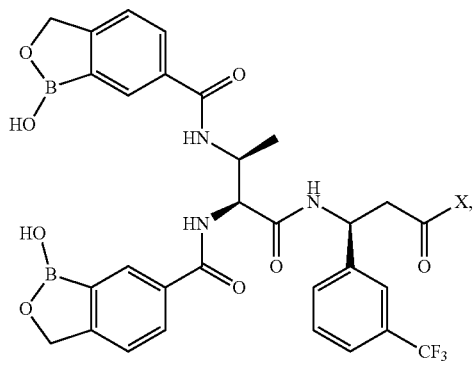
DSL-97
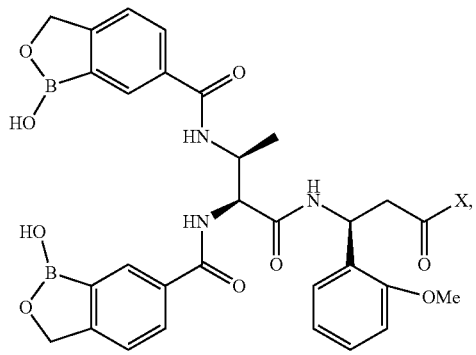
DSL-98
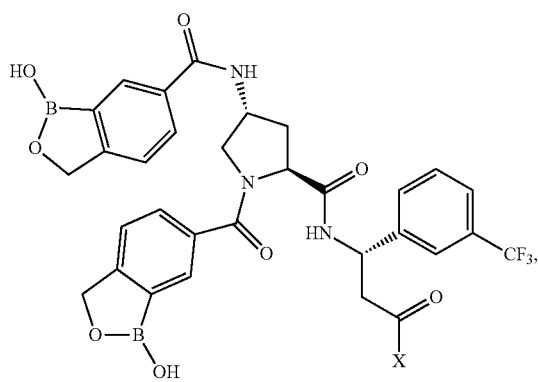
DSL-99
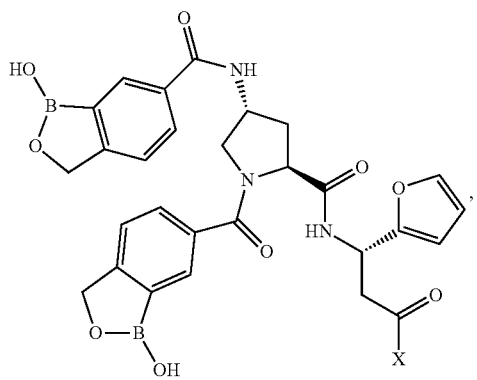

DSL-100
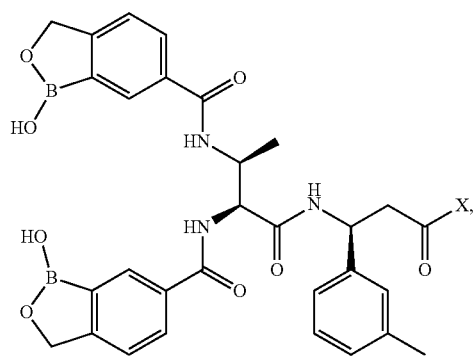
DSL-101
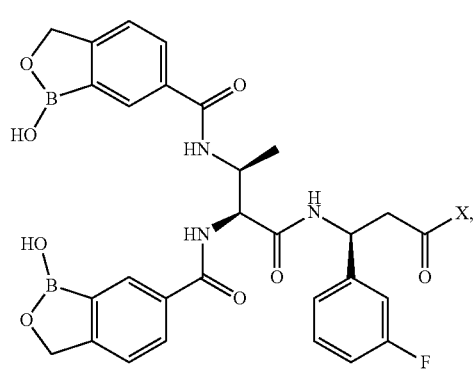
DSL-102
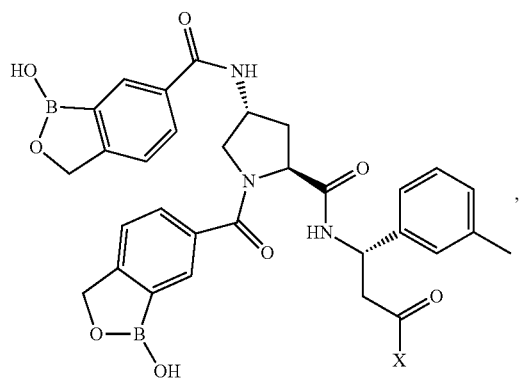
DSL-104
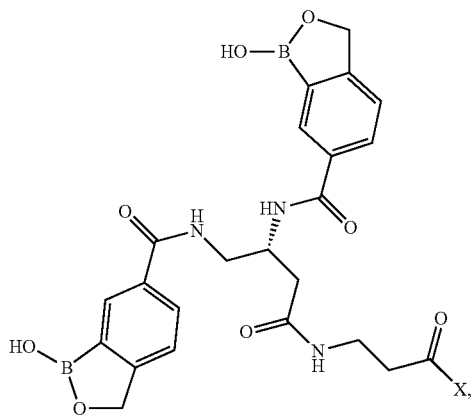
DSL-105
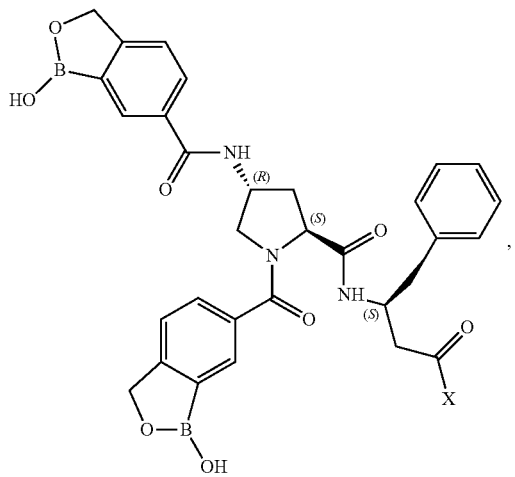
DSL-106
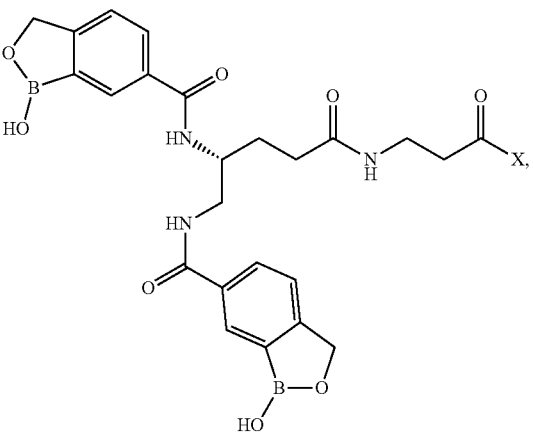

-continued

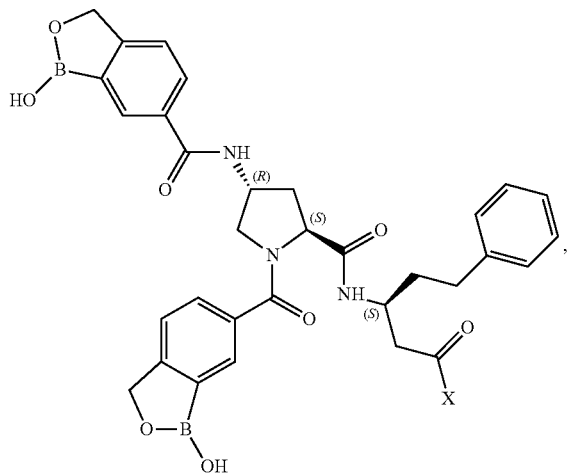

DSL-107

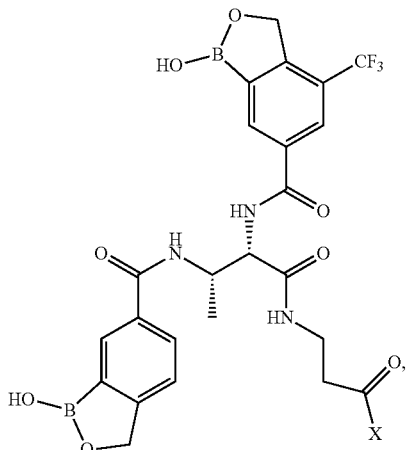

DSL-110

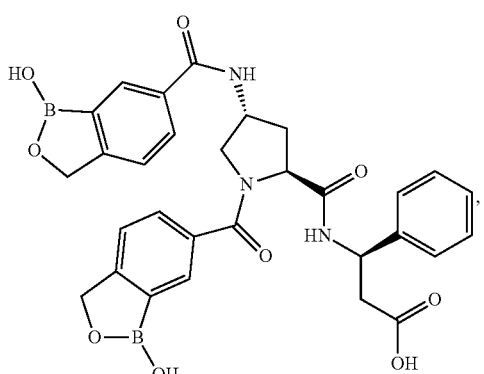

DSL-111

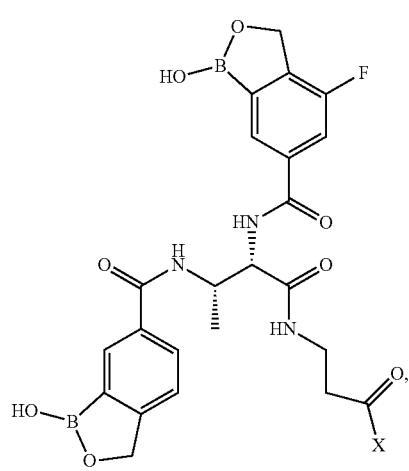

DSL-108

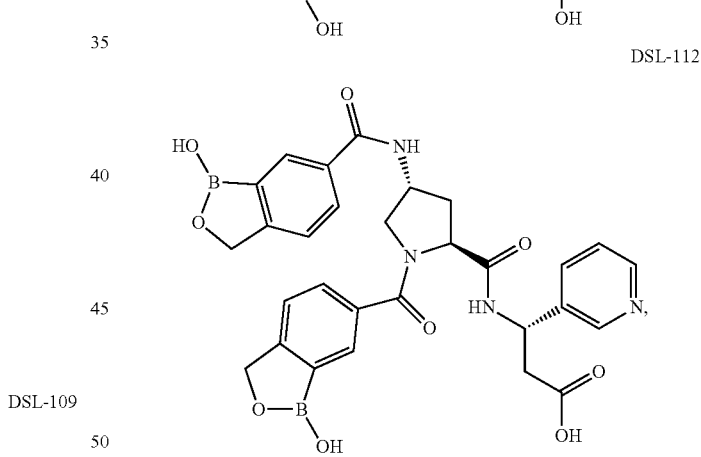

DSL-112

DSL-109 and wherein X is a leaving group or represents a point of covalent attachment directly to X1 of Formula I.

In some embodiments, when X is a leaving group, X is selected from N-oxysuccinimide, 2,3,5,6-tetrafluorophenoxy (TFP), pentafluorophenoxy (Pfp), OH, halogen, maleimide alkyl amino, maleimide amido polyethylene glycol amino, and maleimide polyethylene glycol amino.

In some embodiments, X is selected from N-oxysuccinimide and OH. In some embodiments, X is OH. In some embodiments, X is N-oxysuccinimide. In some embodiments, the maleimide polyethylene glycol amino is selected from Mal-PEG2-amine, Mal-PEG4-amine, and Mal-PEG5-amine, or a pharmaceutically acceptable salt thereof. In some embodiments, the maleimide alkyl amino is selected from Mal-C$_6$-amine and N-(2-Aminoethyl)maleimide, or a pharmaceutically acceptable salt thereof. In some embodiments, the maleimide amido polyethylene glycol amino is selected from Mal-amido-PEG9-amine, Mal-amido-PEG11-amine, Mal-amido-PEG23-amine, 4-Mal-methyl-cyclohexanecarboxamide-methyl-[1,2,3]triazole-PEG8-amine, or a pharmaceutically acceptable salt thereof. In some embodiments, the Z1c-Linker is selected from:

DSL-1A

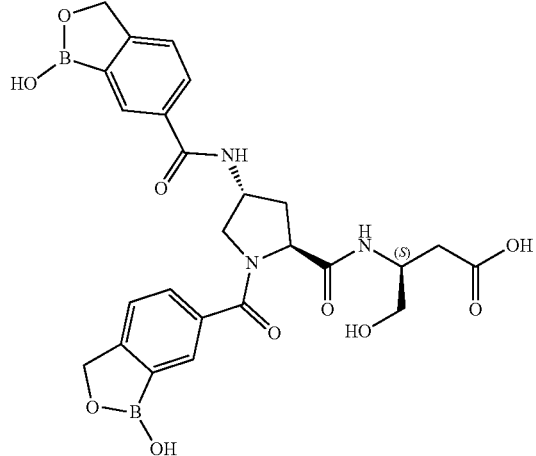

DSL-2A

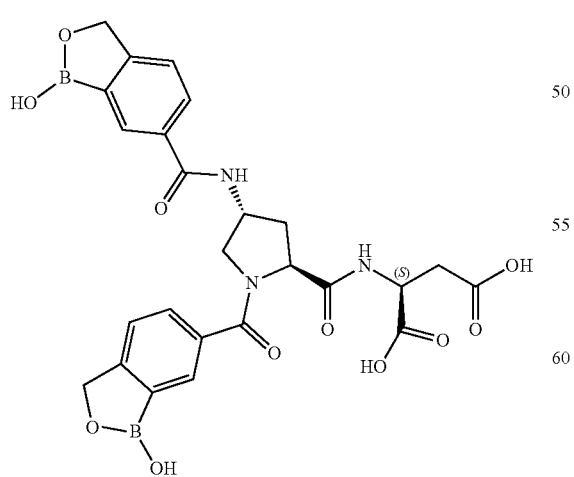

DSL-3A

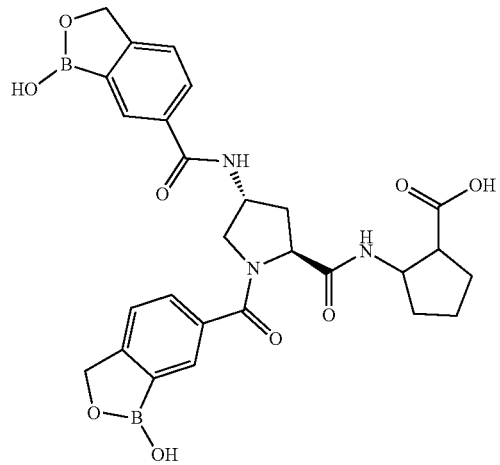

DSL-4A

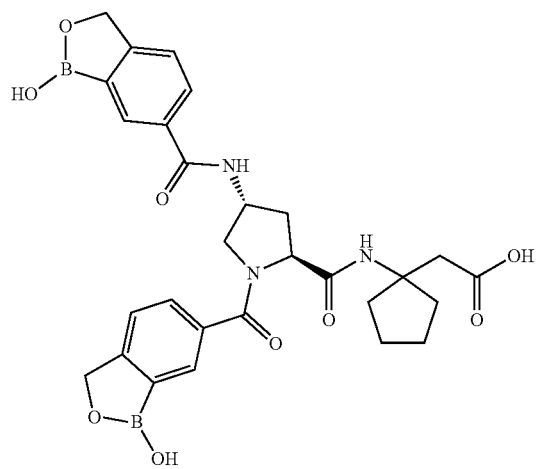 [SMILES: O=C(O)CC1(NC(=O)[C@@H]2C[C@@H](NC(=O)c3ccc4c(c3)B(O)OC4)CN2C(=O)c2ccc3c(c2)B(O)OC3)CCCC1]

DSL-5A

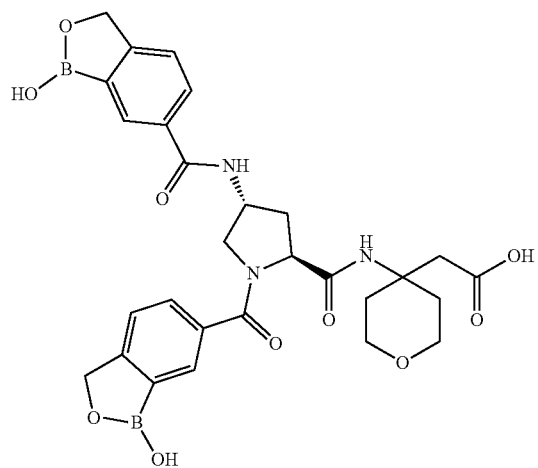 [SMILES: O=C(O)CC1(NC(=O)[C@@H]2C[C@@H](NC(=O)c3ccc4c(c3)B(O)OC4)CN2C(=O)c2ccc3c(c2)B(O)OC3)CCOCC1]

DSL-6A
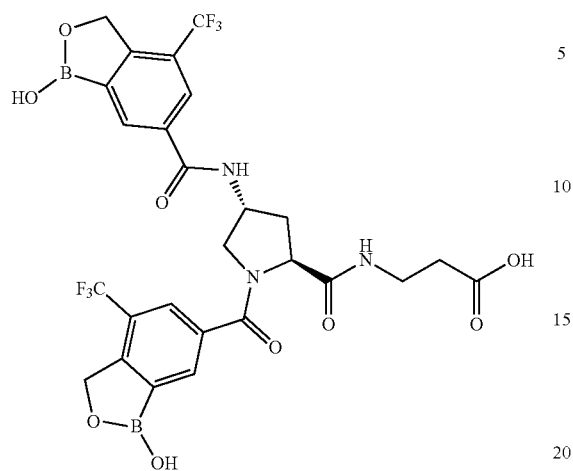
DSL-7A
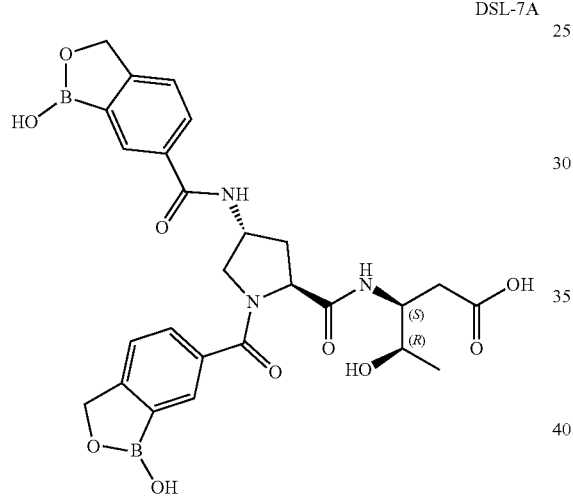
DSL-8A
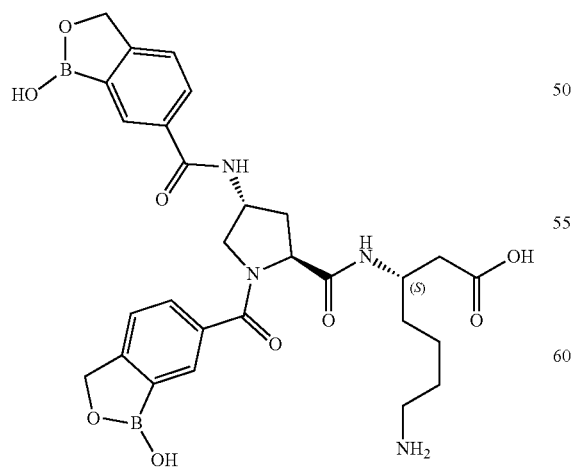
DSL-9A
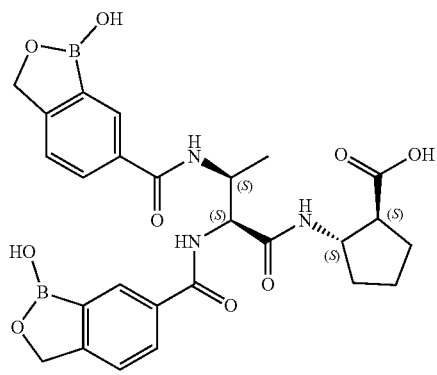
DSL-10A
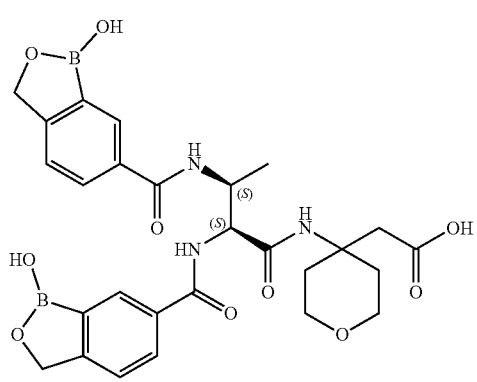
DSL-11A
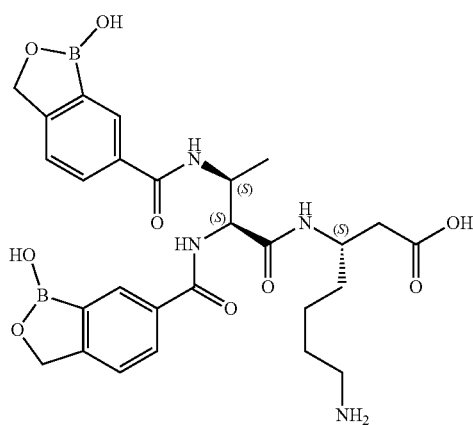
DSL-12A
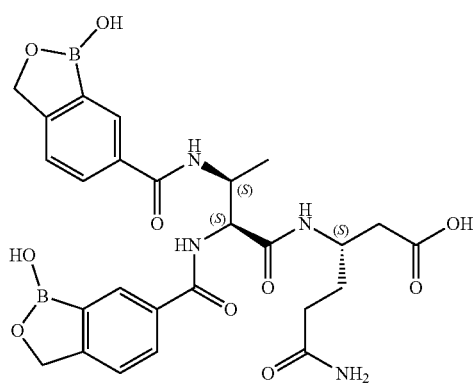

DSL-13A
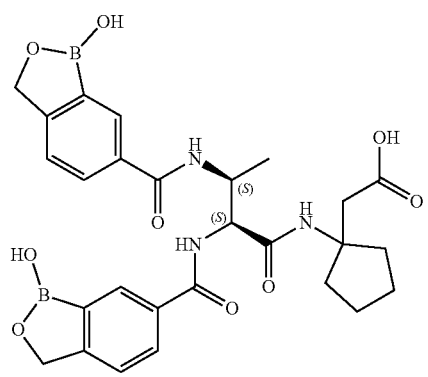
DSL-14A
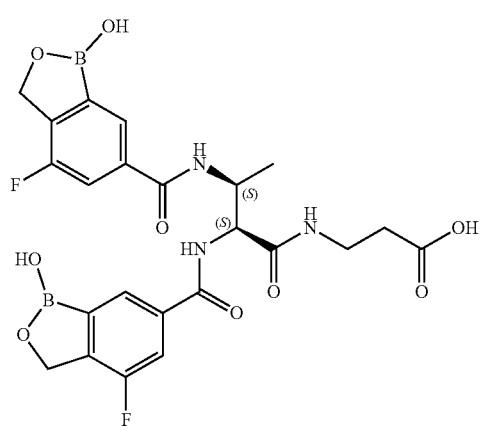
DSL-15A
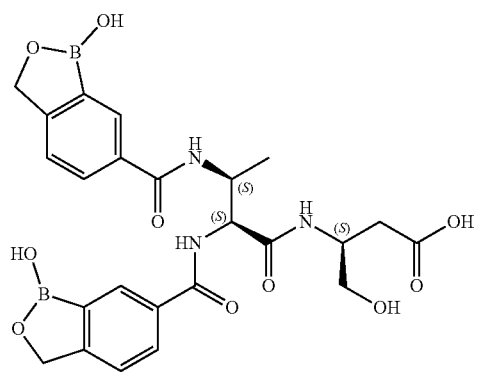
DSL-16A
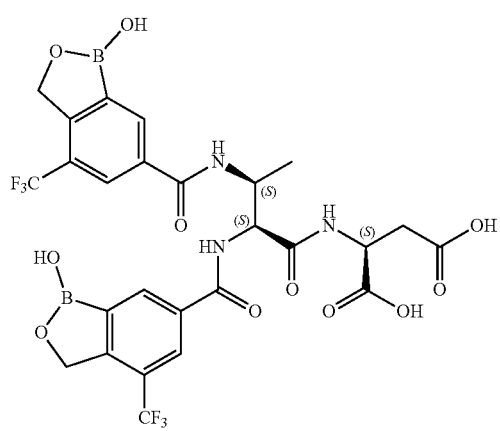
DSL-17A
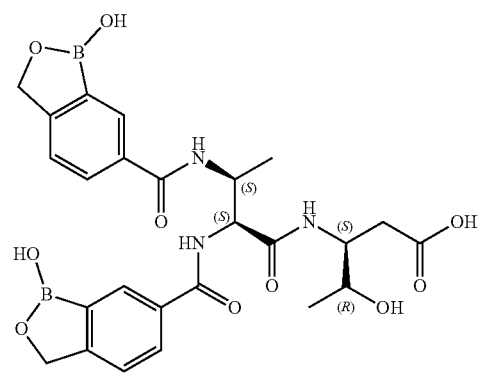
DSL-18A
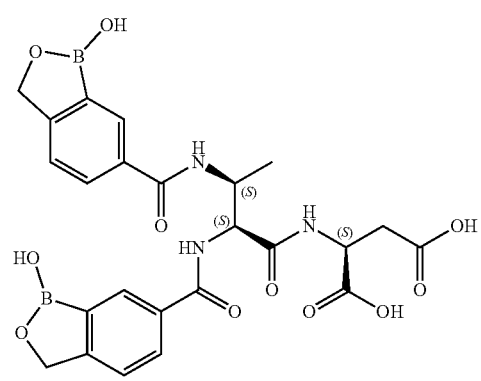
DSL-19A
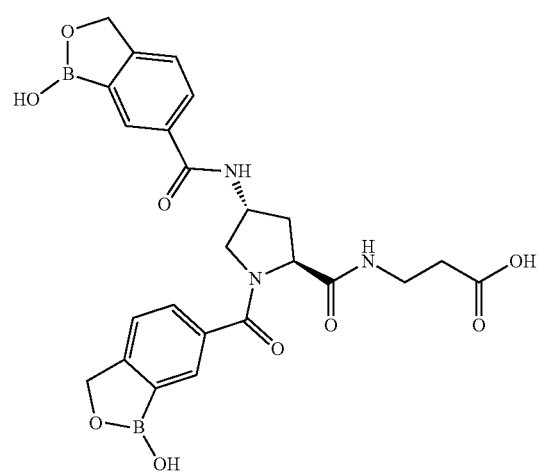 [SMILES: O=C(O)CCNC(=O)[C@@H]1C[C@@H](NC(=O)c2ccc3c(c2)B(O)OC3)CN1C(=O)c1ccc2c(c1)B(O)OC2]

DSL-20A
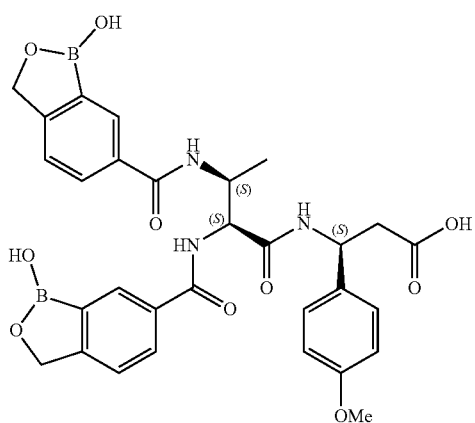
DSL-21A
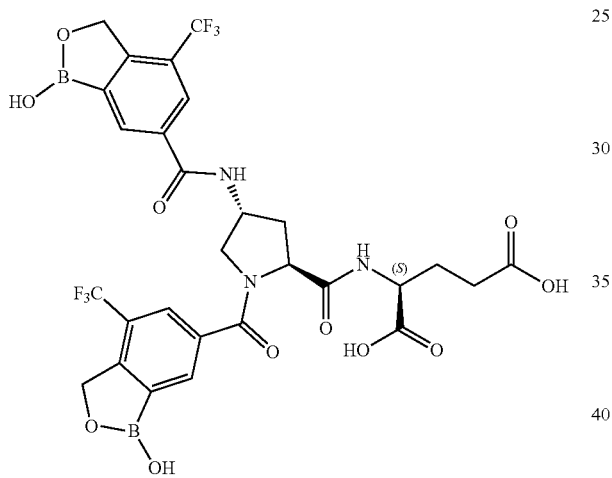
DSL-22A
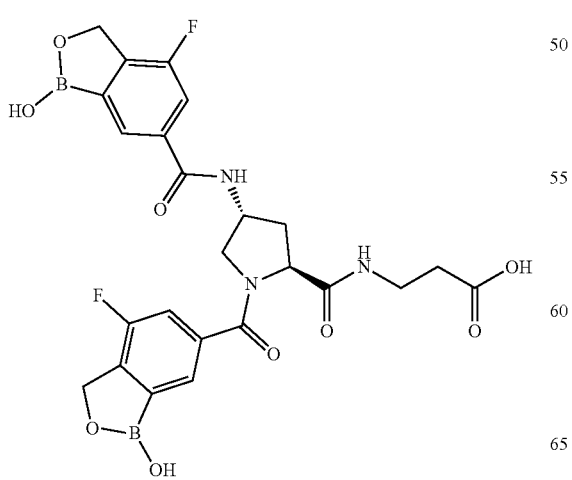
DSL-23A
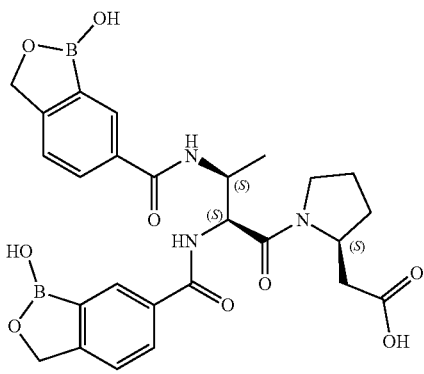
DSL-24A
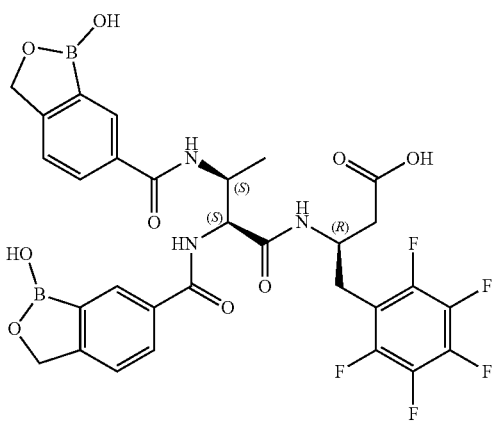
DSL-25A
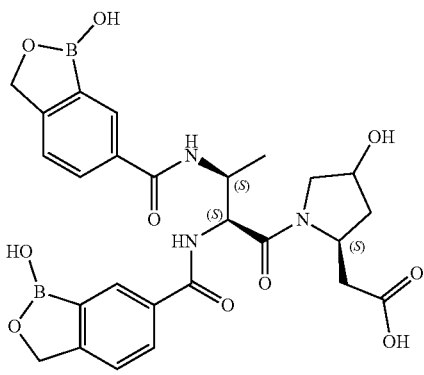
DSL-26A
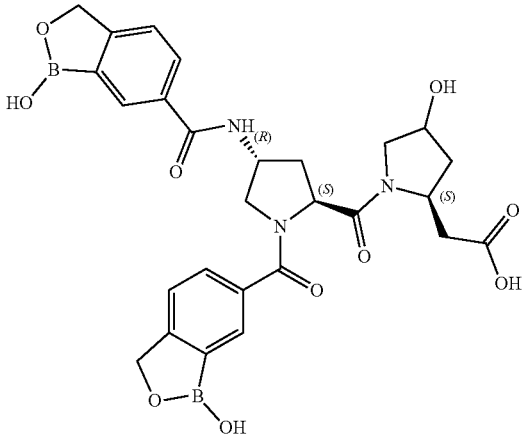

DSL-27A
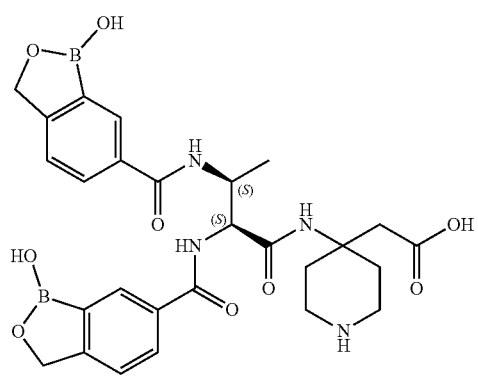
DSL-28A
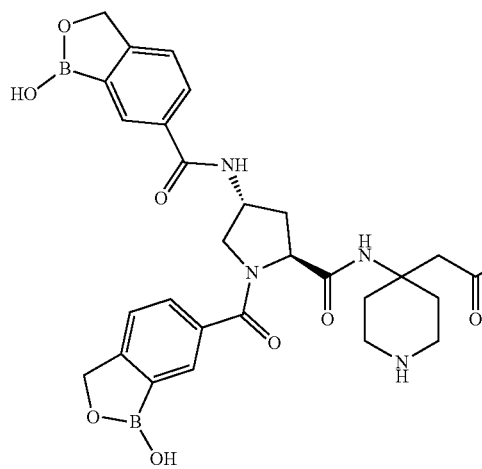
DSL-29A
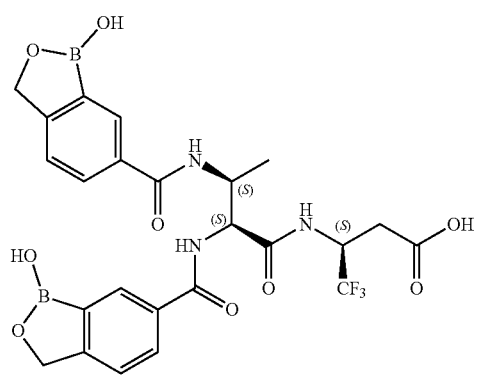
DSL-30A
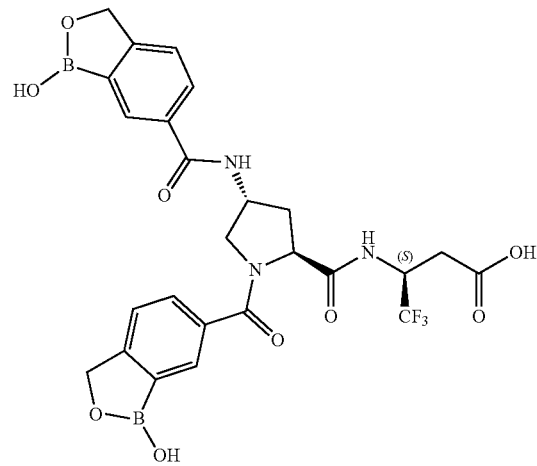
DSL-31A
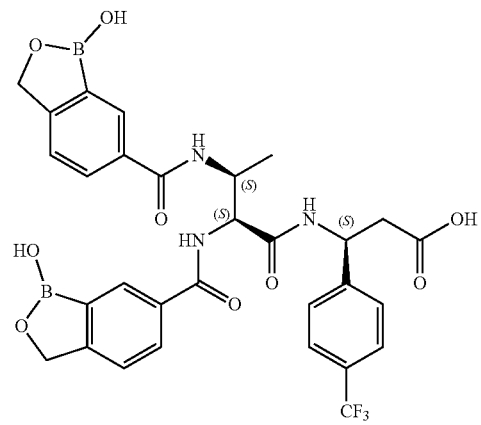
DSL-32A
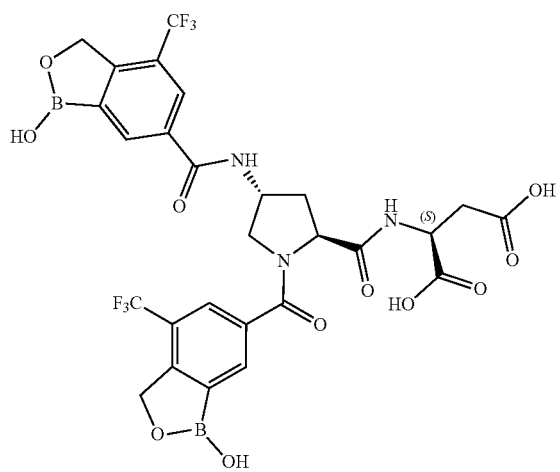

DSL-33A
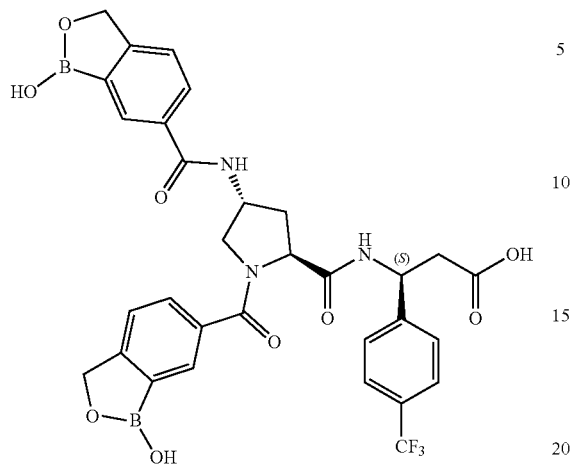
DSL-36A
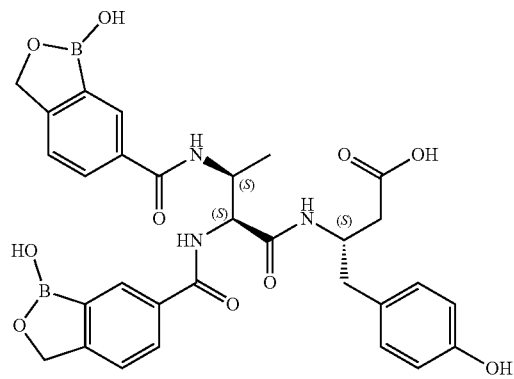
DSL-34A
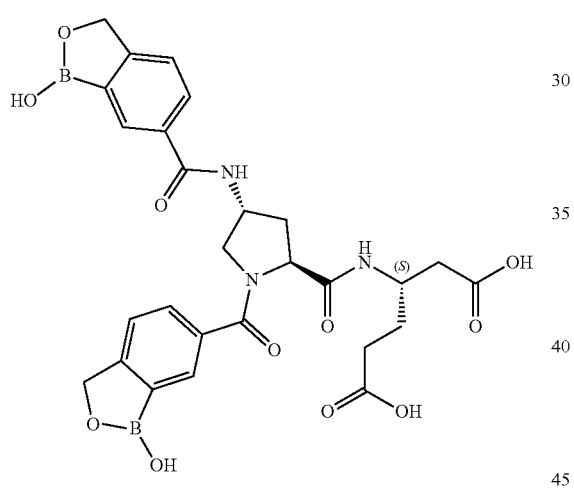
DSL-37A
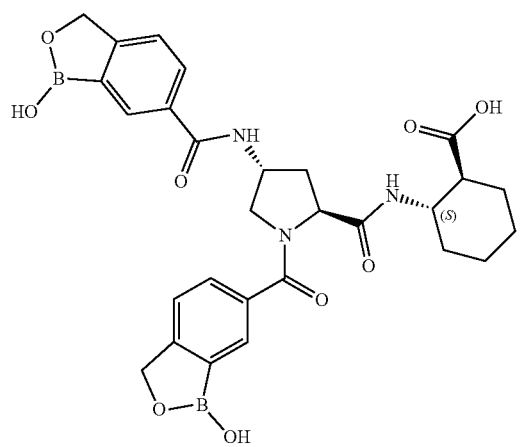
DSL-35A
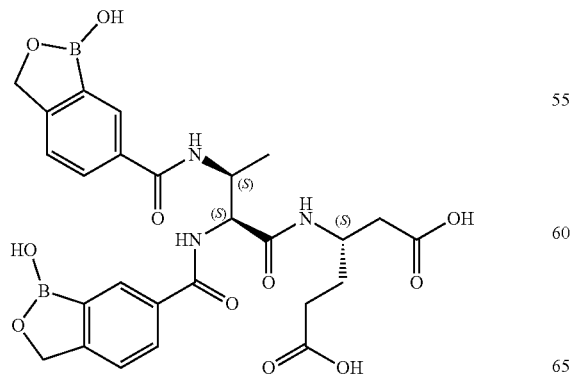
DSL-38A
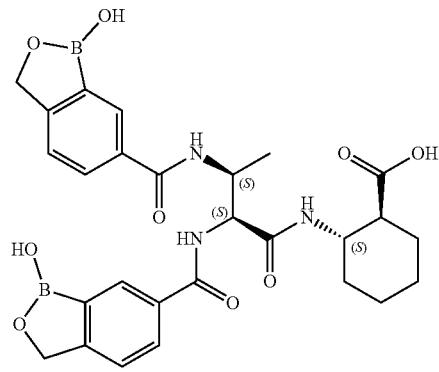

DSL-39A
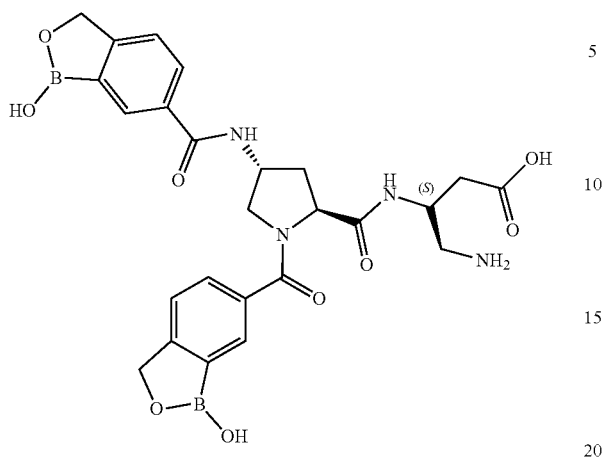
DSL-40A
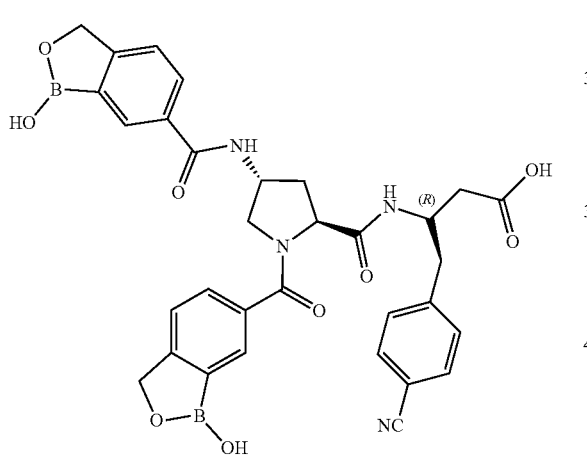
DSL-41A
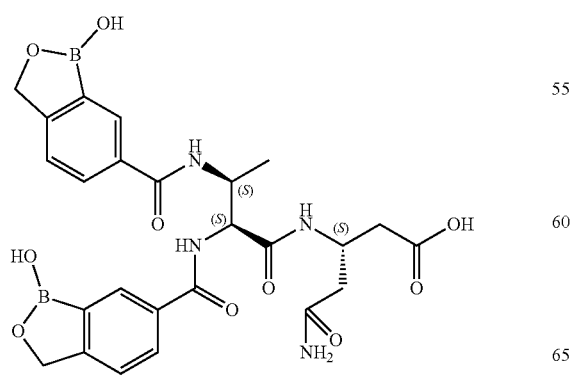
DSL-42A
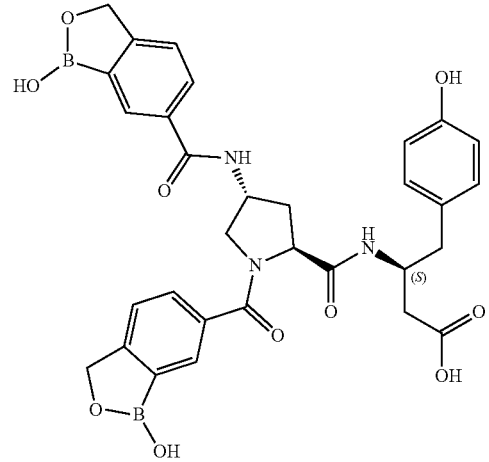
DSL-43A
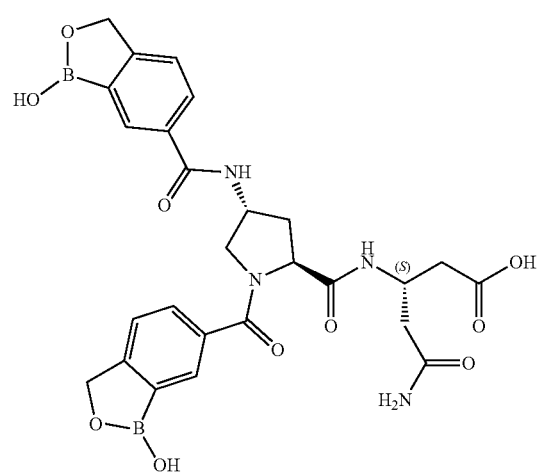
DSL-44A
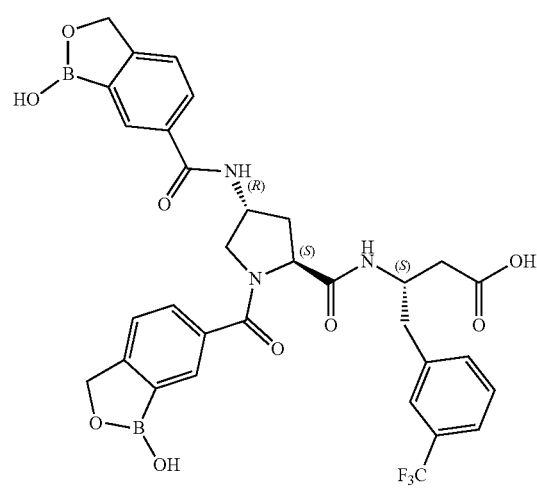

DSL-45A
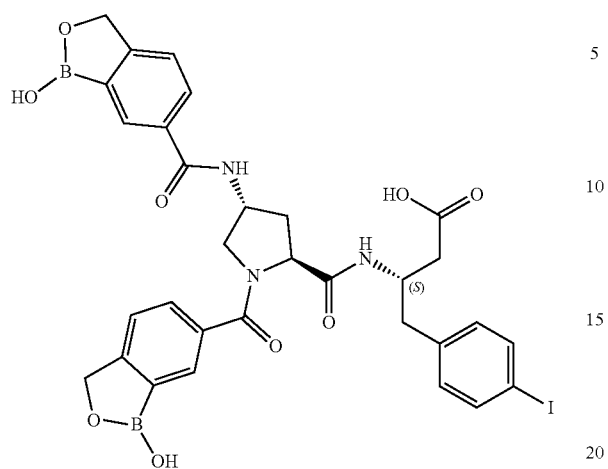
DSL-48A
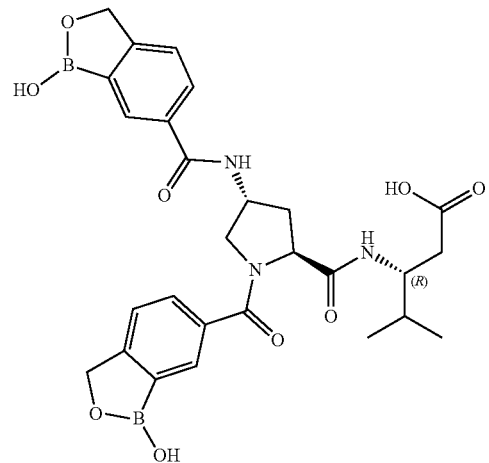
DSL-46A
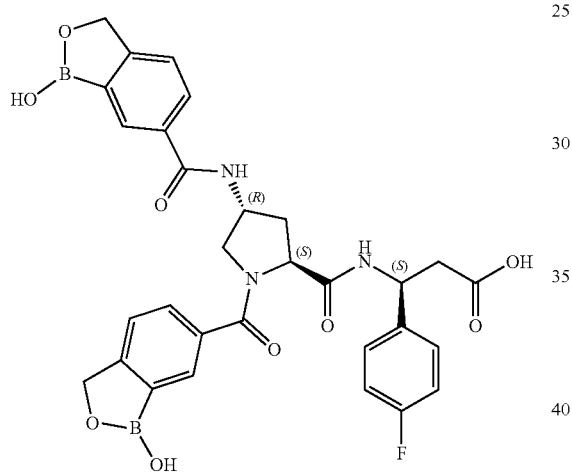
DSL-49A
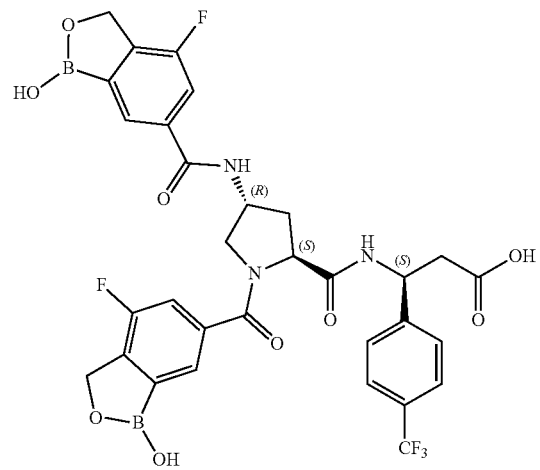
DSL-47A
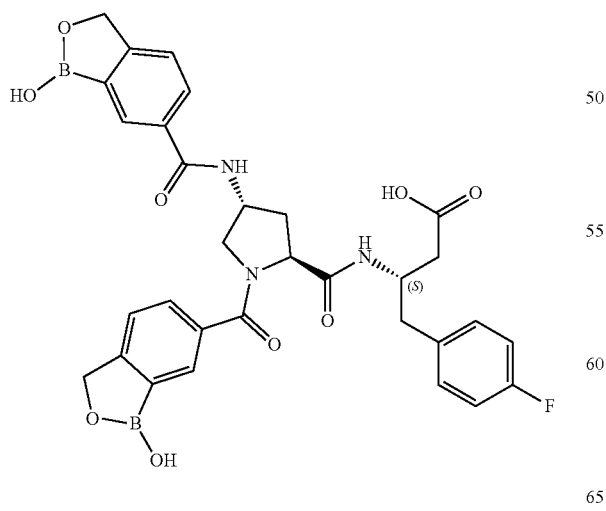
DSL-50A
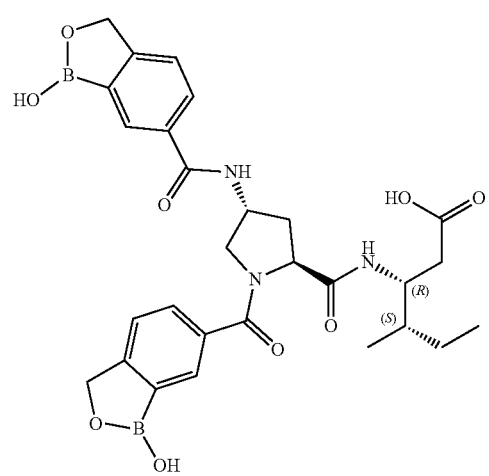

DSL-51A
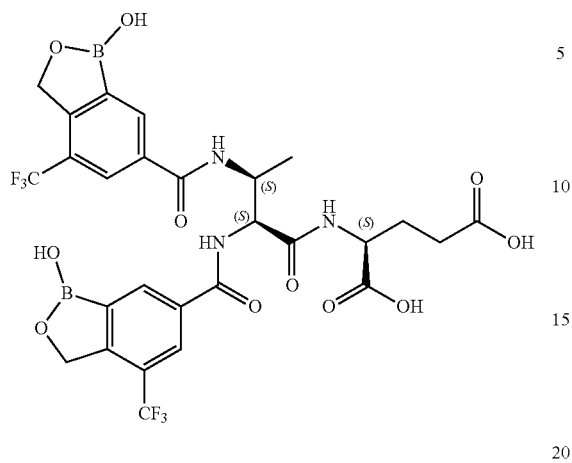
DSL-54A
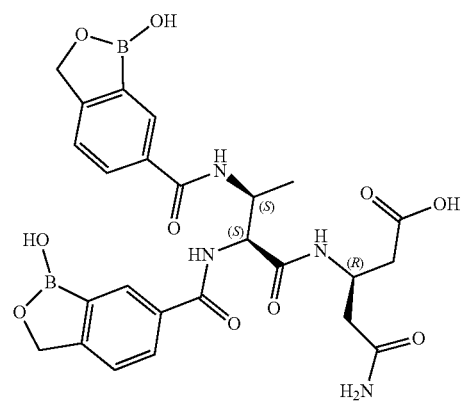
DSL-52A
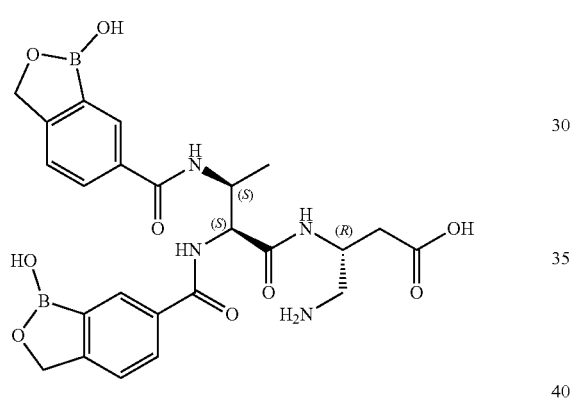
DSL-55A
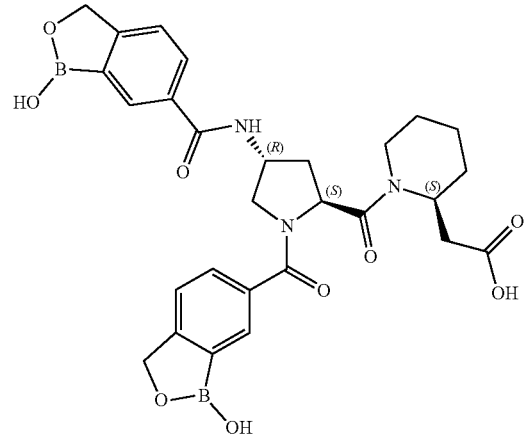
DSL-53A
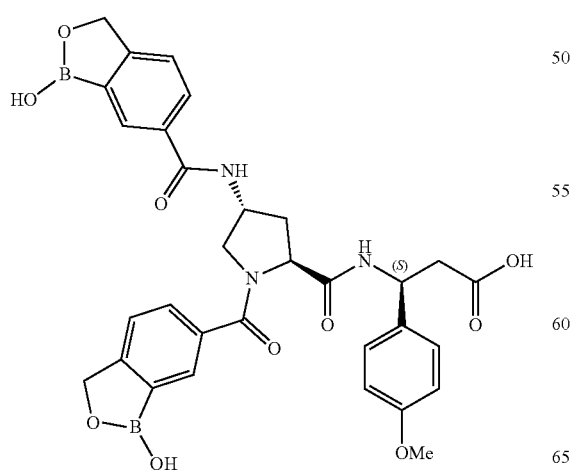
DSL-56A
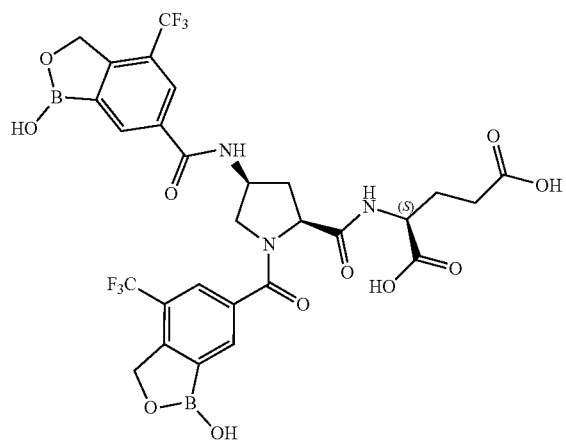

-continued
DSL-57A
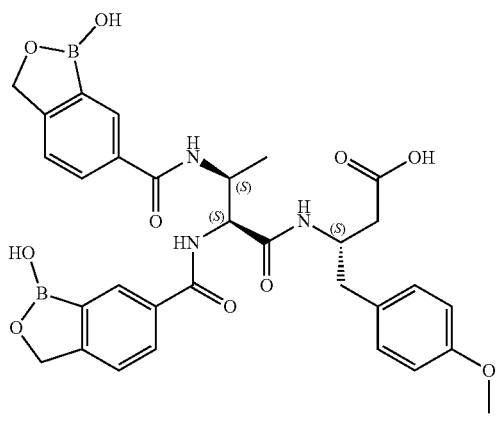
DSL-60A
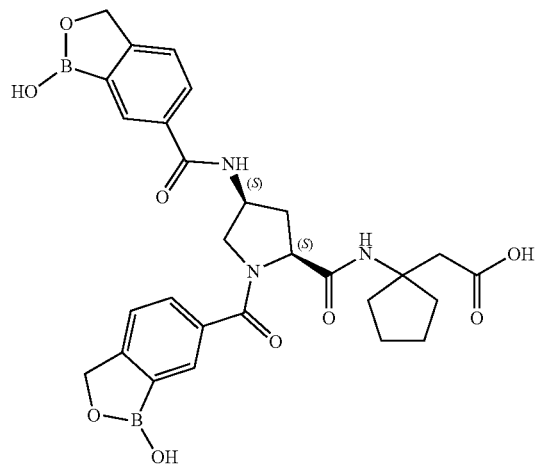
DSL-58A
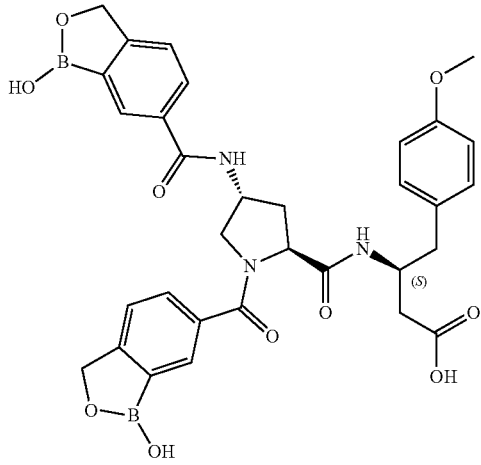
DSL-61A
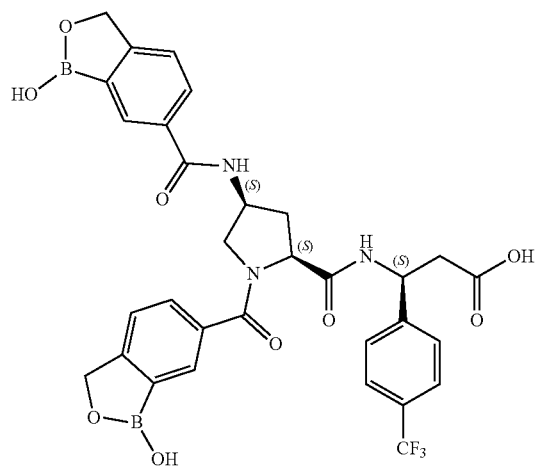
DSL-59A
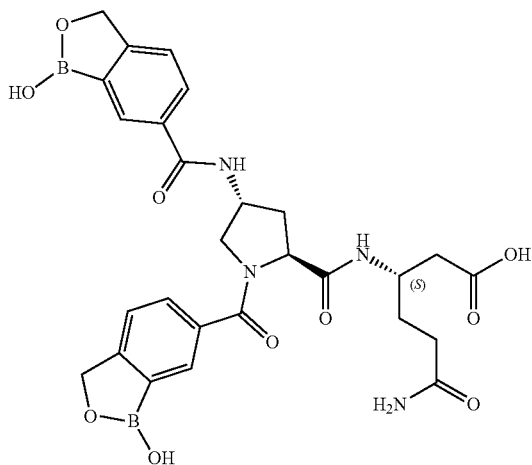
DSL-62A
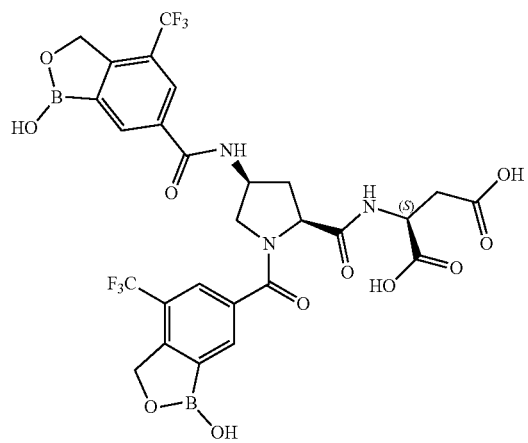

DSL-63A
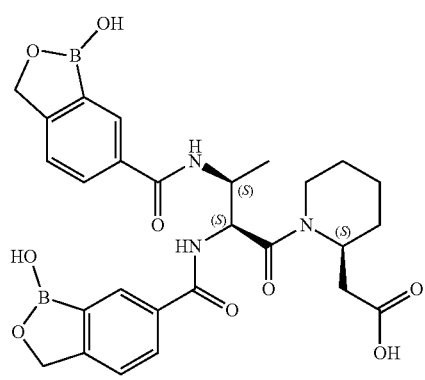
DSL-64A
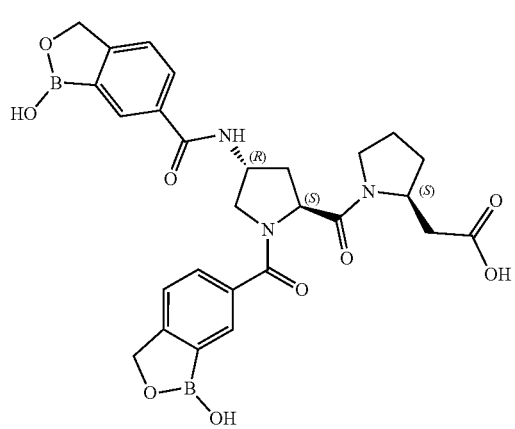
DSL-65A
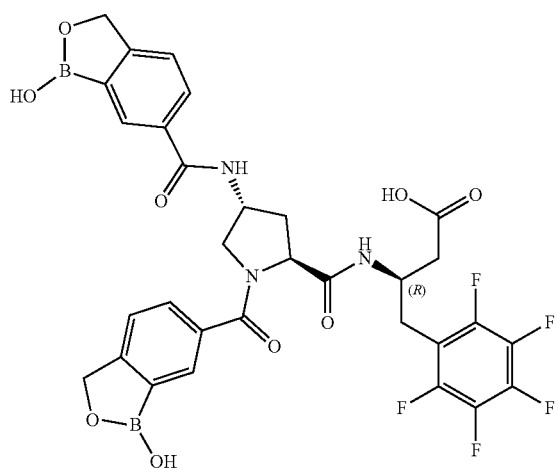
DSL-66A
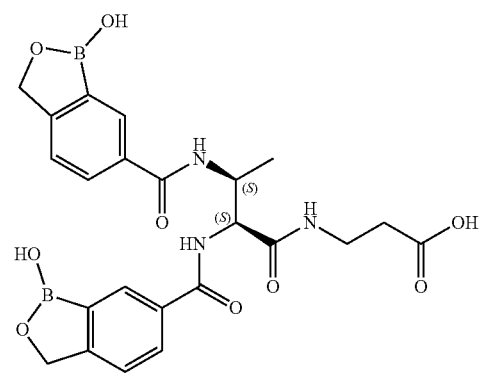
DSL-67A
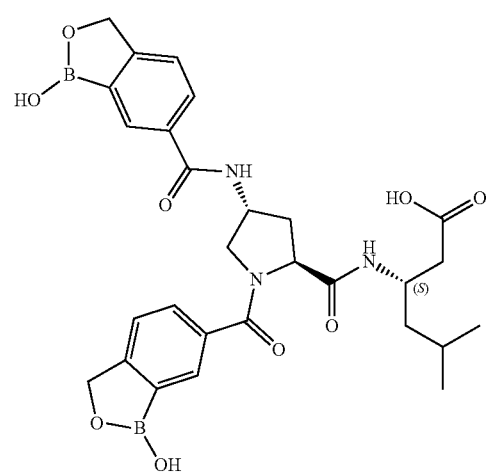
DSL-68A
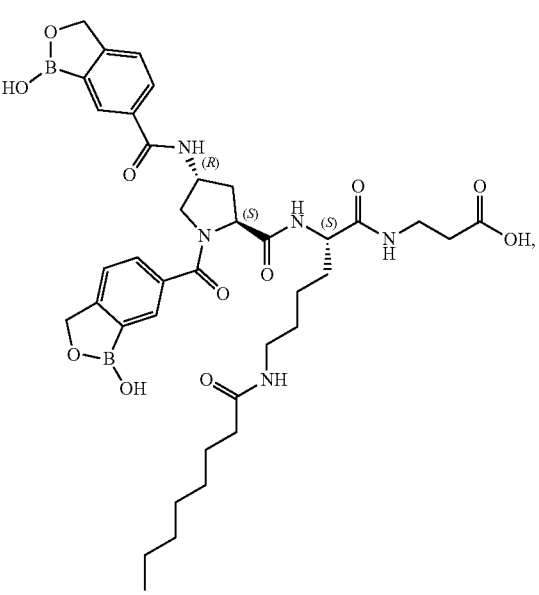

DSL-69A
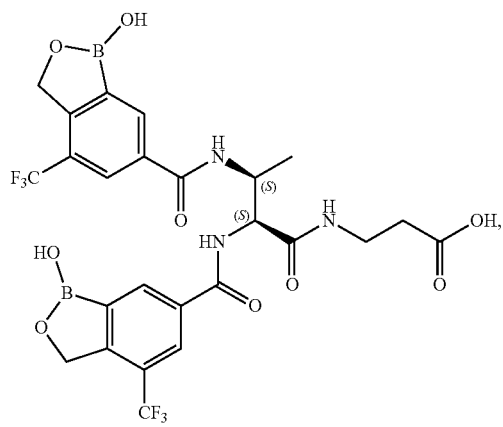
DSL-70A
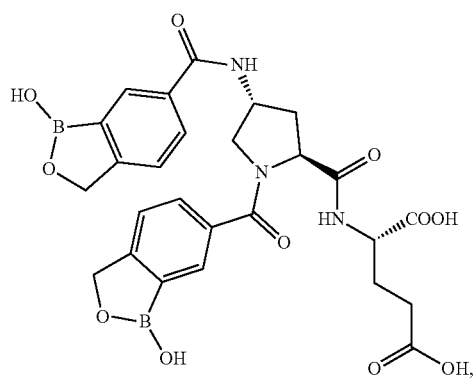
DSL-71A
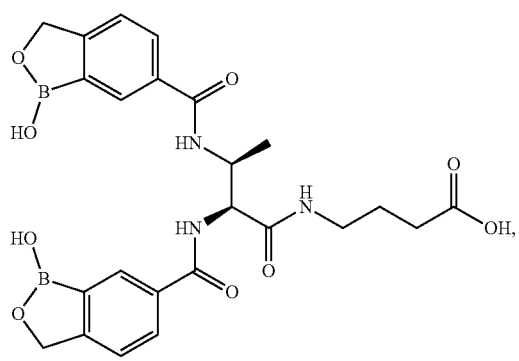
DSL-72A
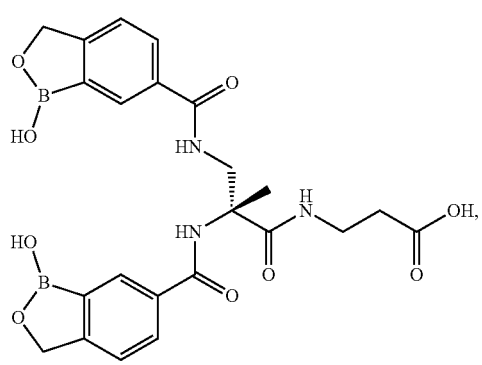
DSL-73A
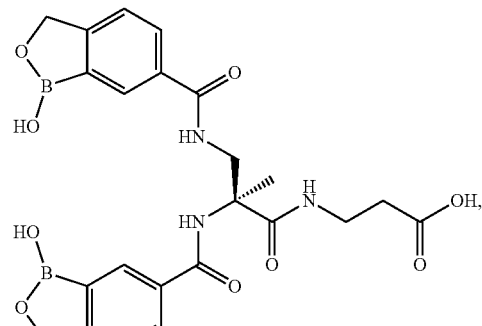
DSL-74A
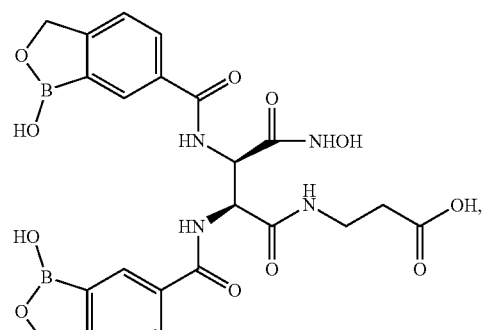
DSL-75A
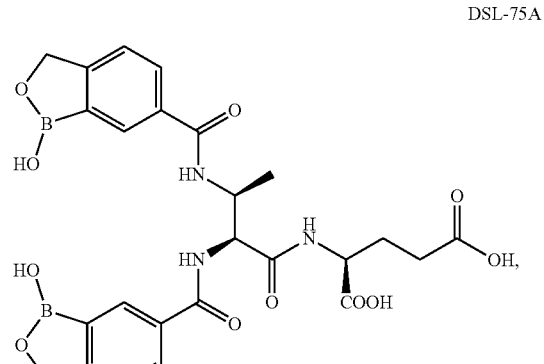
DSL-76A
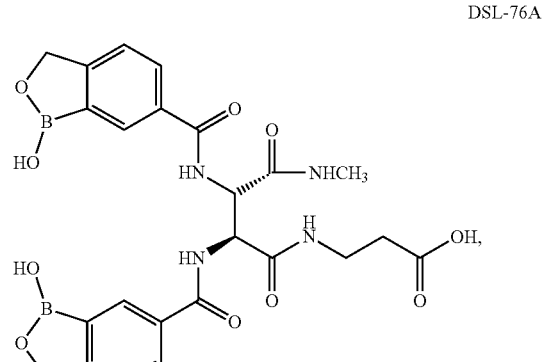

DSL-77A
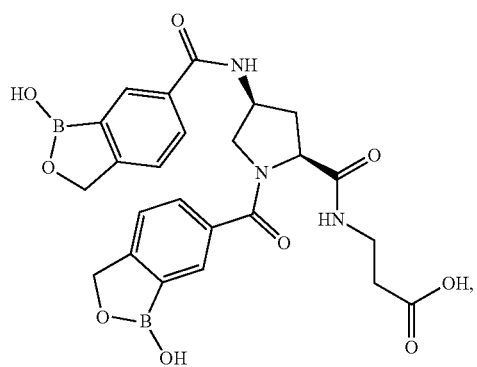
DSL-78A
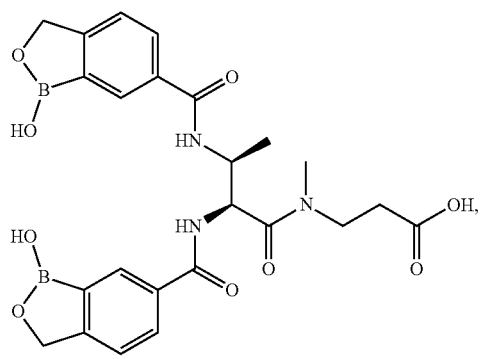
DSL-79A
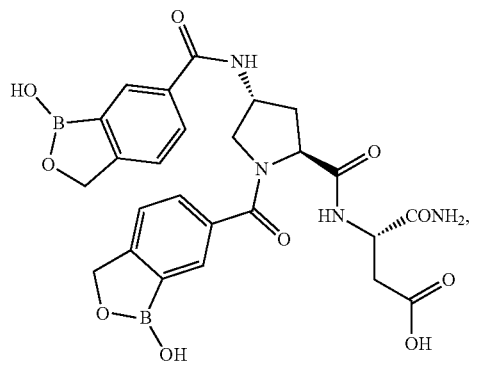
DSL-80A
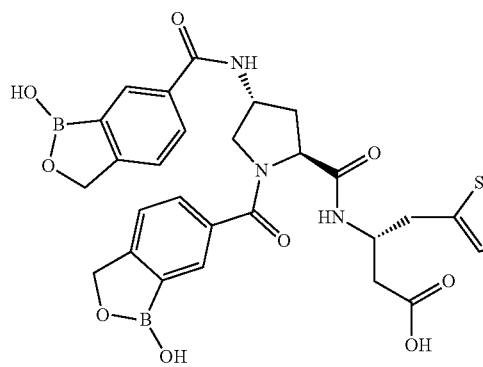
DSL-81A
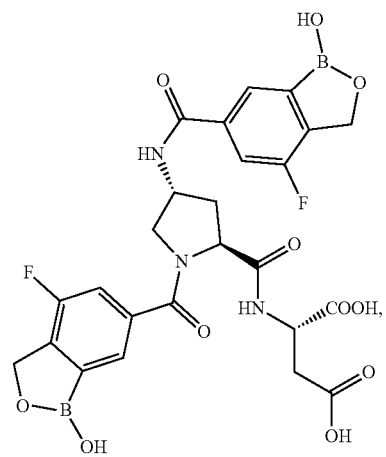
DSL-82A
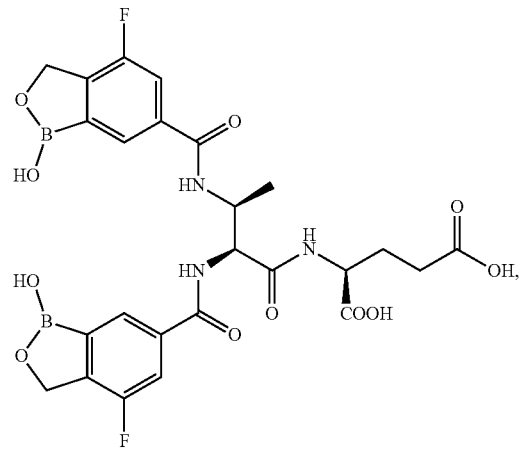
DSL-83A
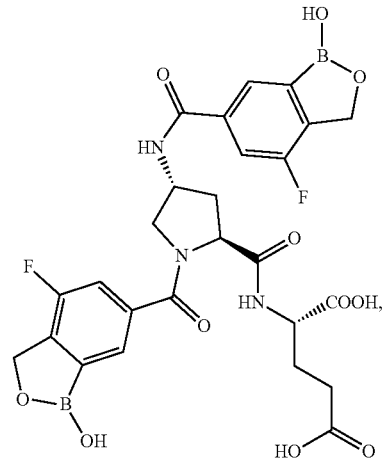

DSL-84A
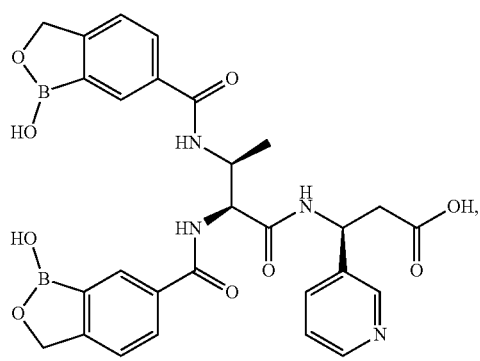
DSL-88A
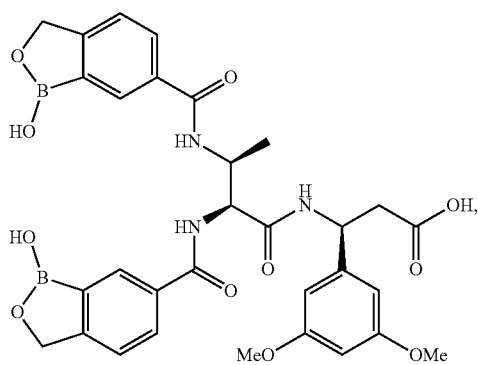
DSL-85A
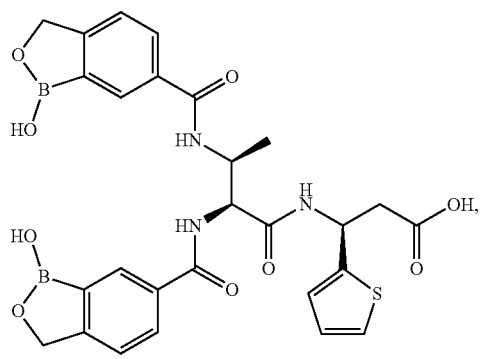
DSL-89A
DSL-86A
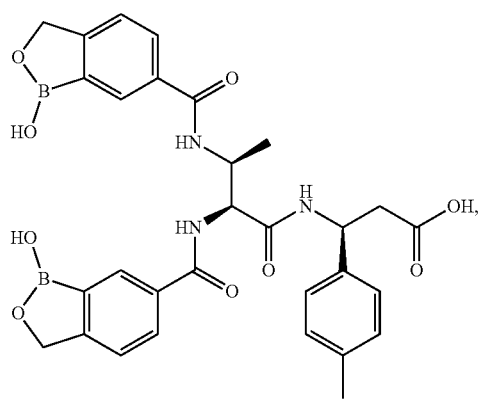
DSL-90A
DSL-87A
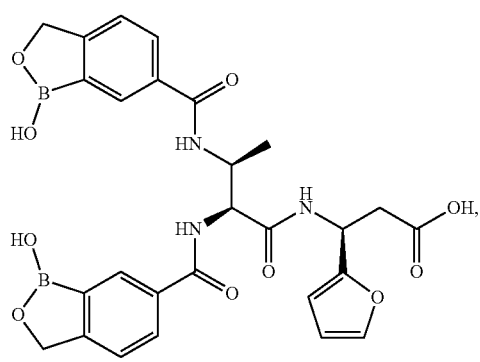
DSL-91A -continued
DSL-92A
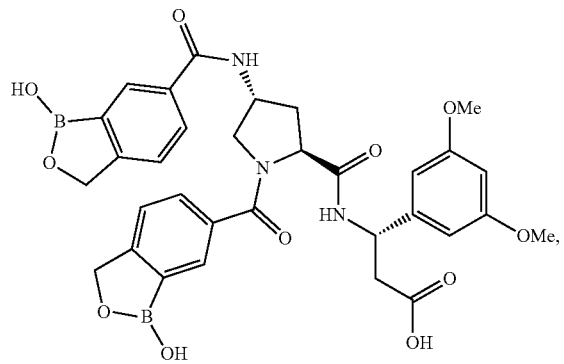
DSL-93A
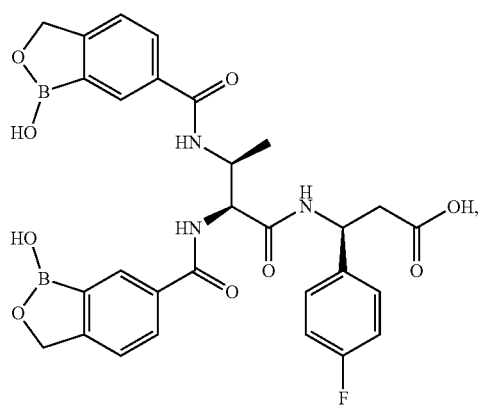
DSL-94A
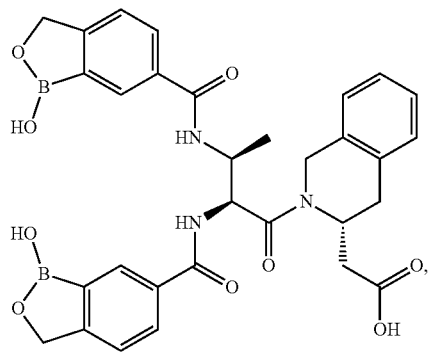
DSL-95A
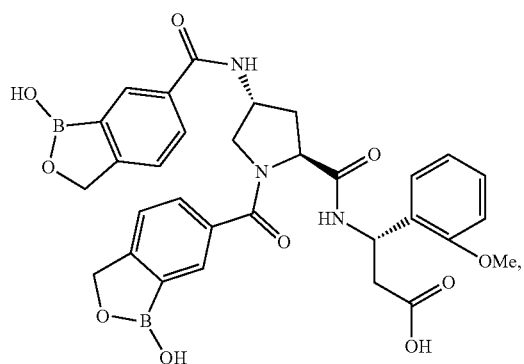
-continued
DSL-96A
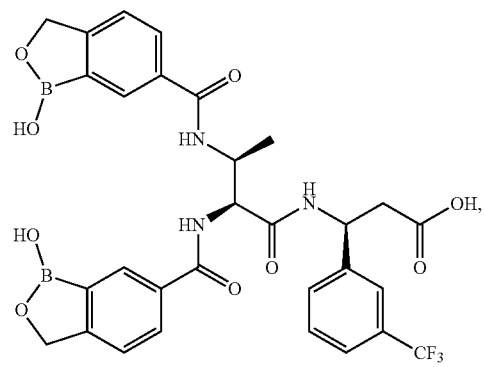
DSL-97A
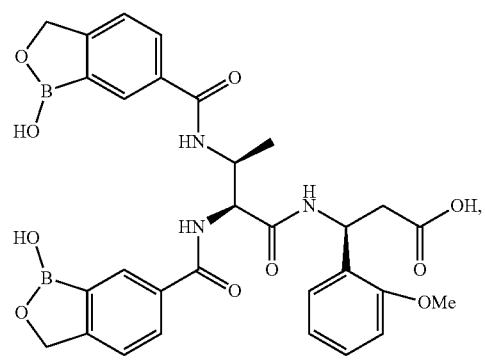
DSL-98A
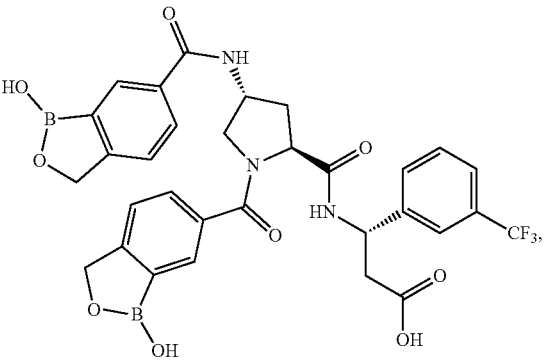
DSL-99A
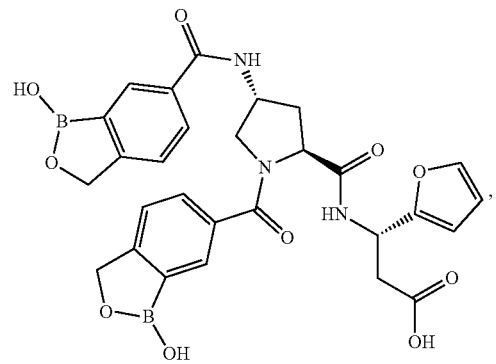

DSL-100A
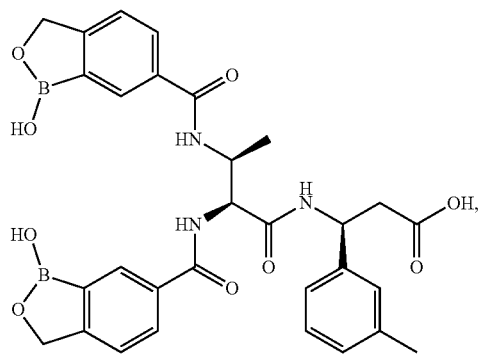
DSL-101A
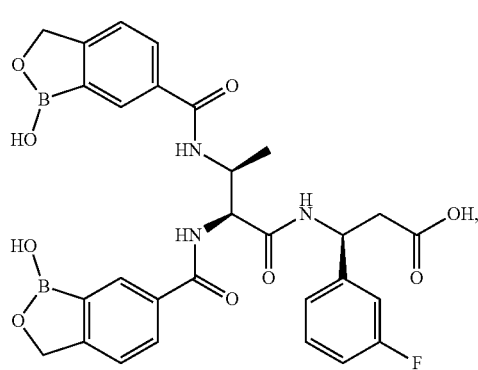
DSL-102A
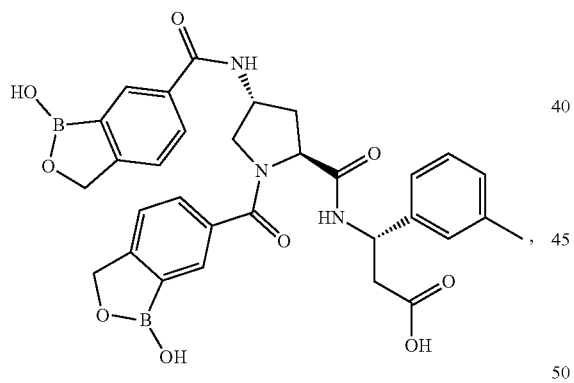
DSL-103A
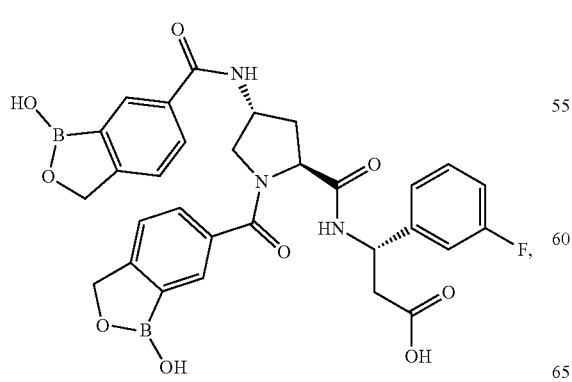
DSL-104A
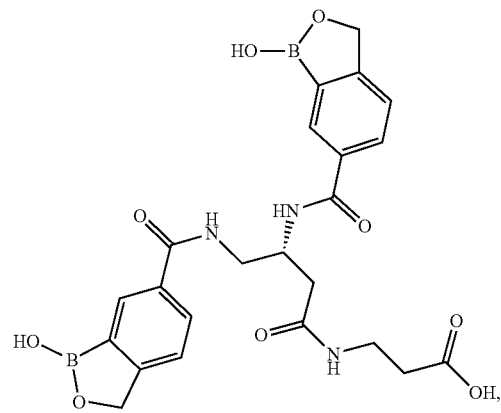
DSL-105A
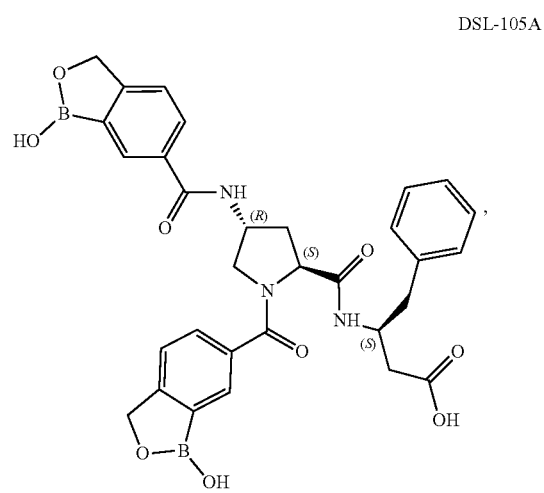
DSL-106A
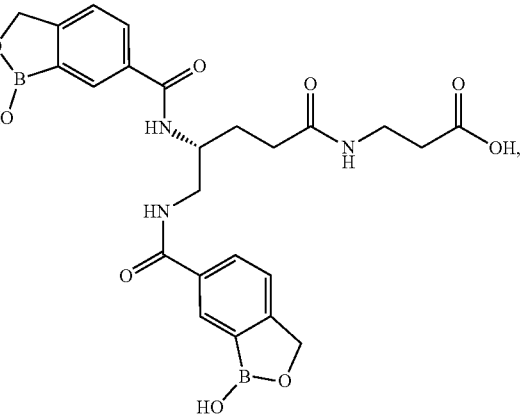

385
-continued
DSL-107A
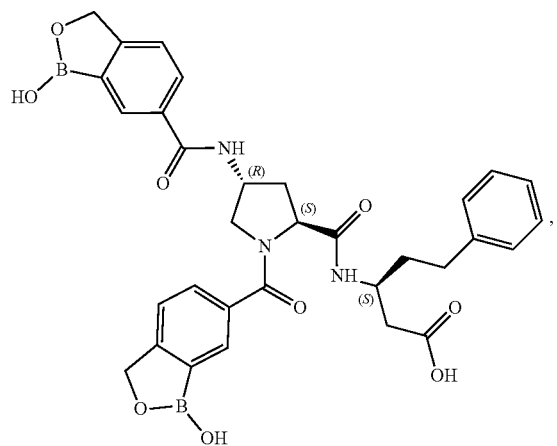
DSL-108A
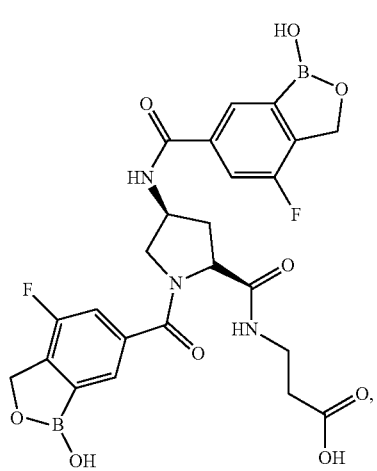
DSL-109A
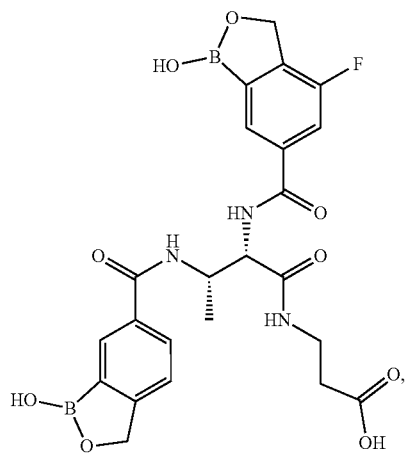
386
-continued
DSL-110A
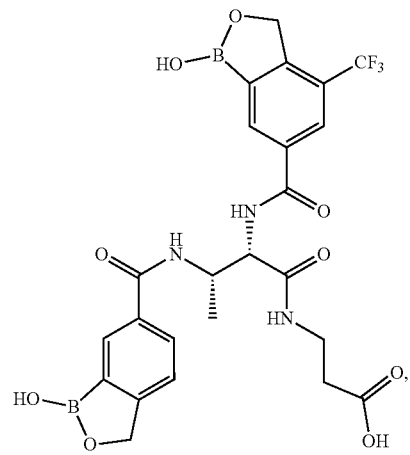
DSL-111A
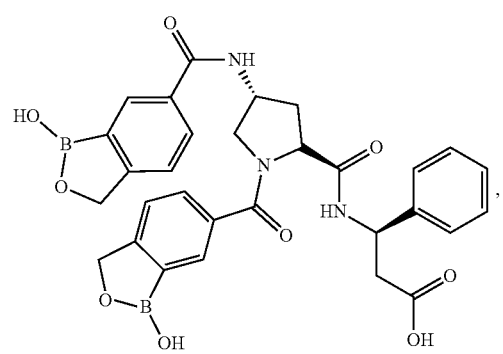
DSL-112A
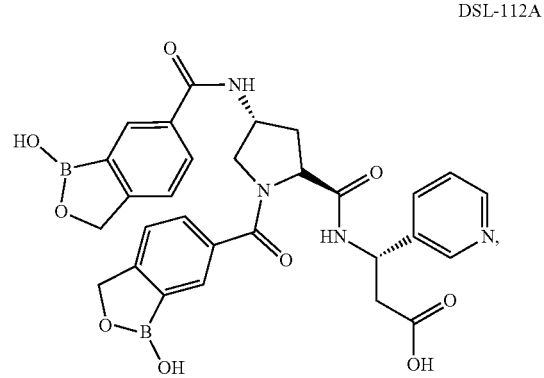
a stereoisomer or a mixture of stereoisomers, a pharmaceutically acceptable salt thereof, and combinations thereof. In some embodiments, the Z1c-Linker is selected from:

-continued
DSL-1B
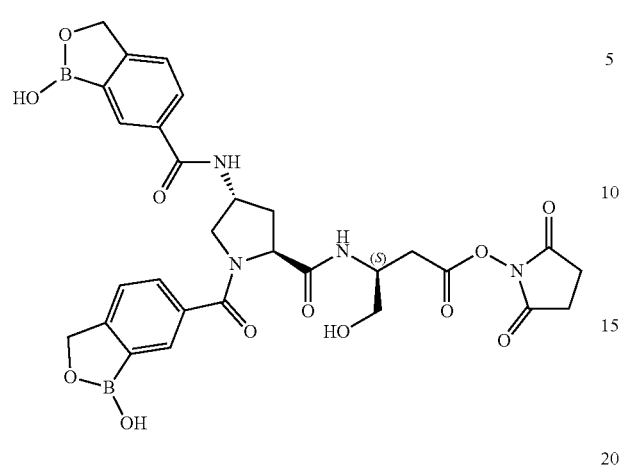
DSL-4B
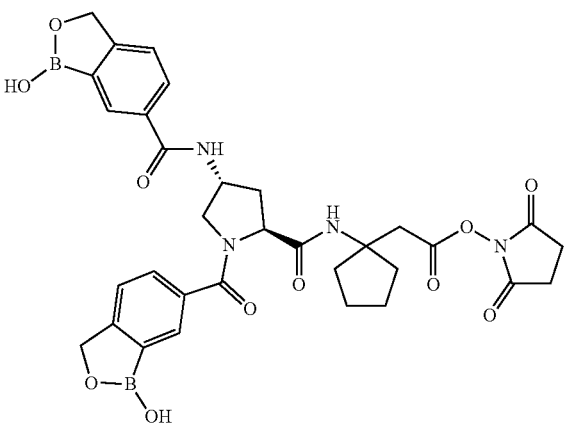
DSL-2B
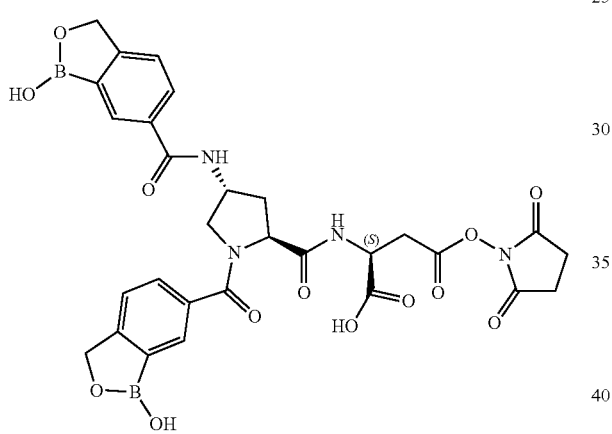
DSL-5B
DSL-3B
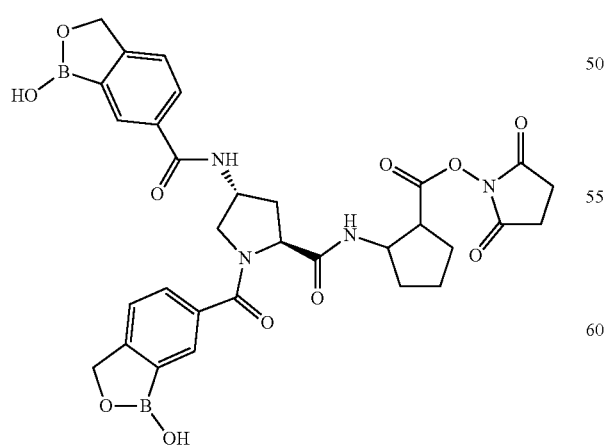
DSL-6B
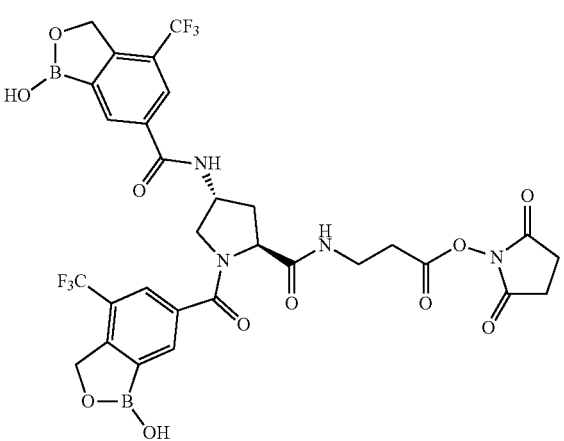

DSL-7B
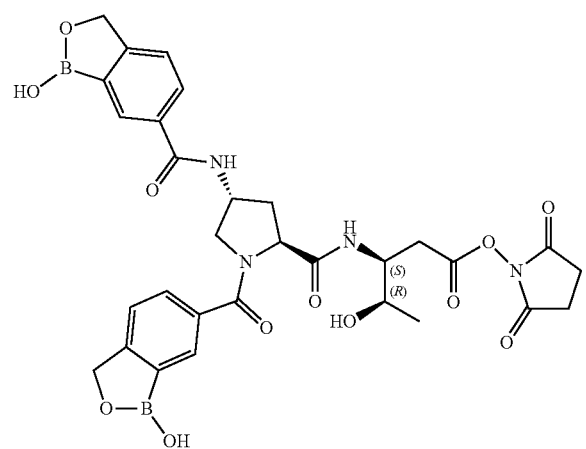
DSL-8B
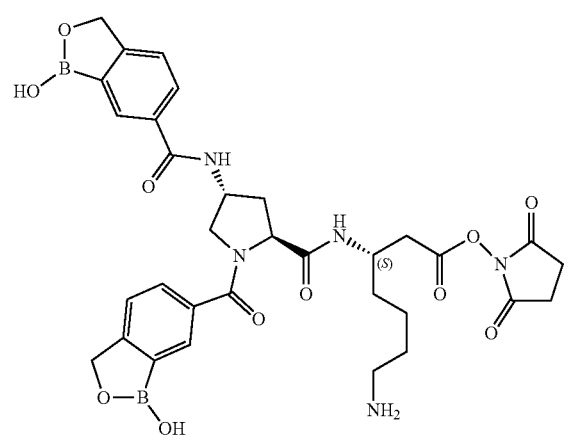
DSL-9B
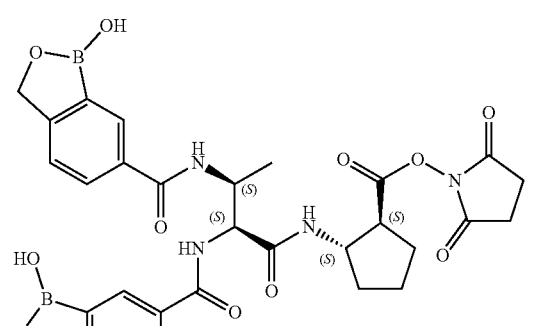
DSL-10B
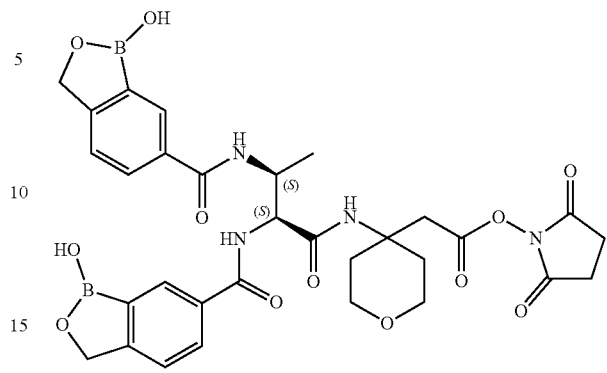
DSL-11B
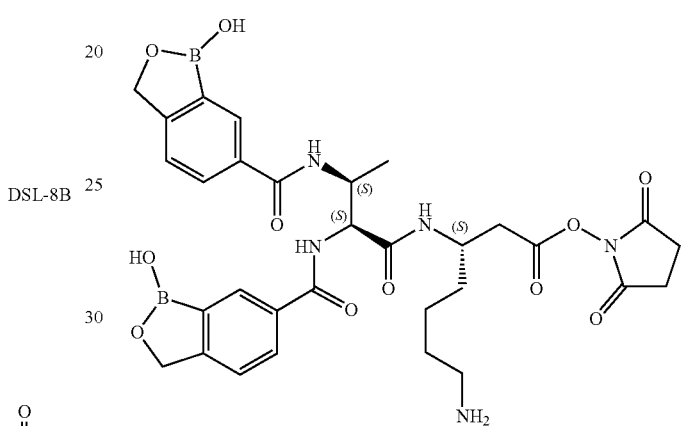
DSL-12B
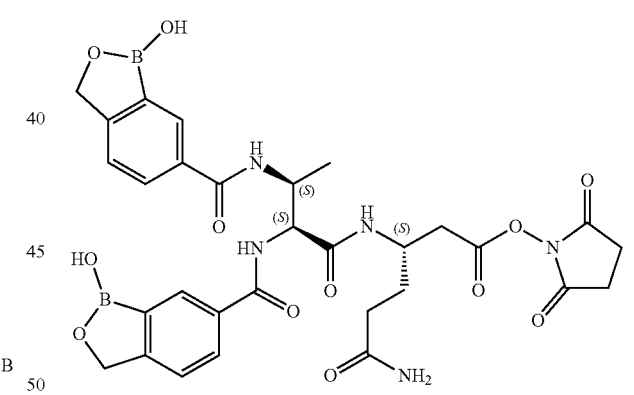
DSL-13B
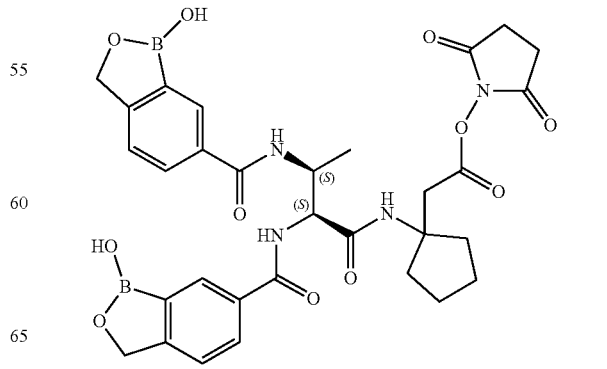

DSL-14B
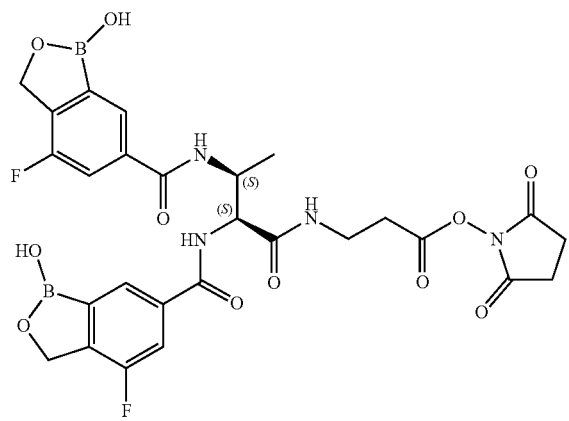
DSL-15B
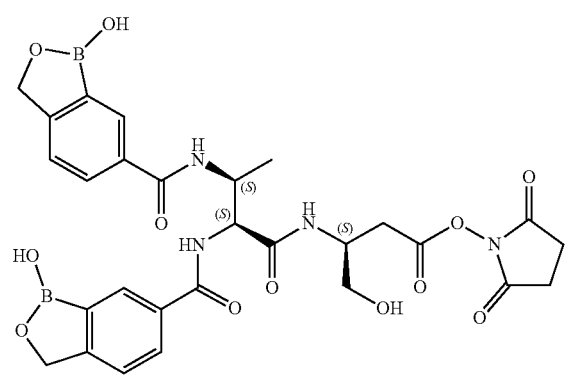
DSL-16B
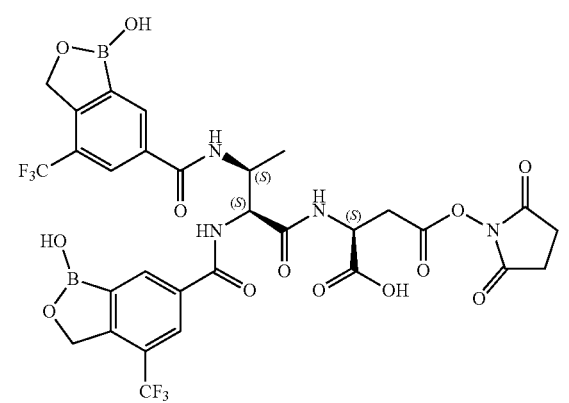
DSL-17B
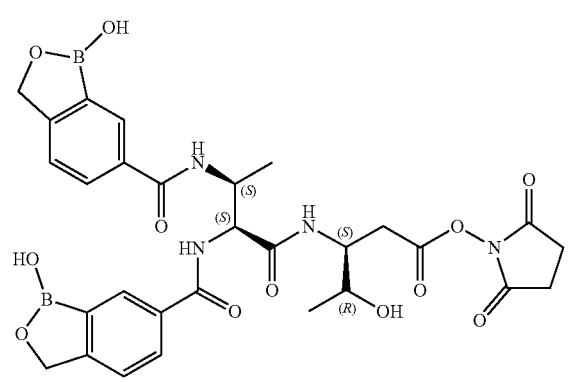
DSL-18B
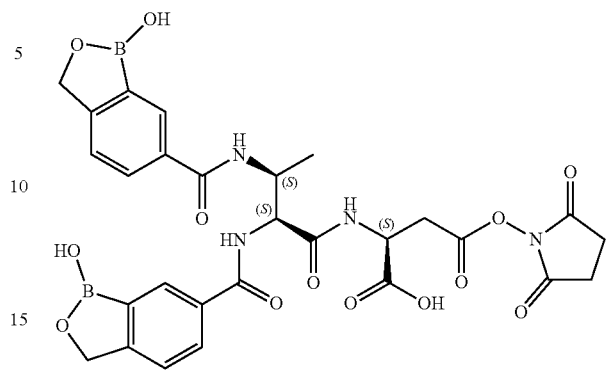
DSL-19B
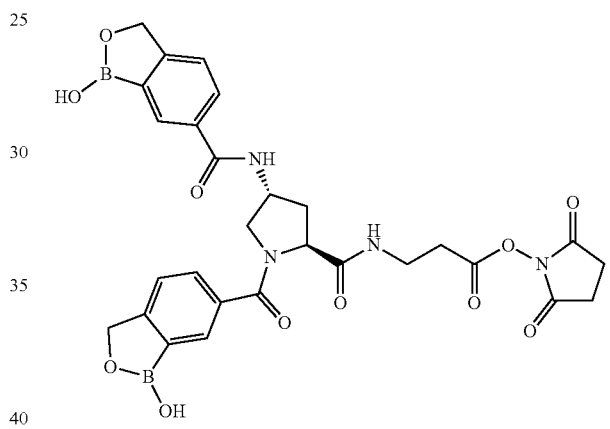
DSL-20B
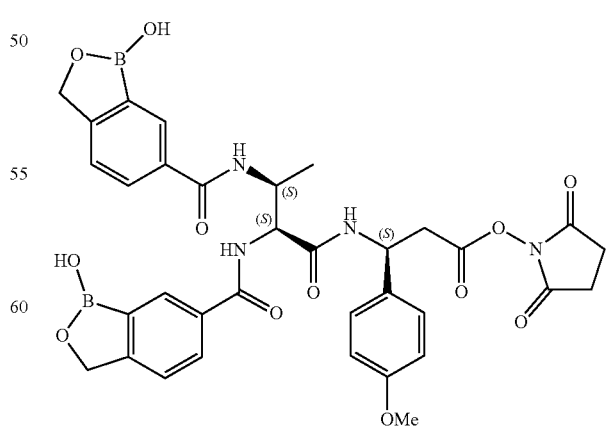

DSL-21B
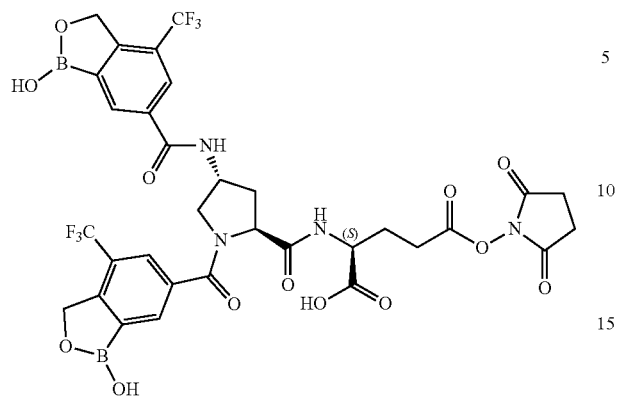
DSL-24B
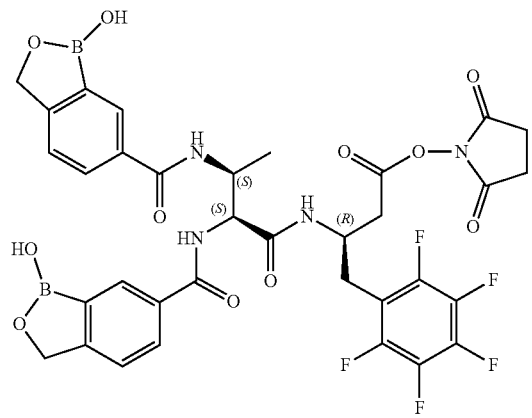
DSL-22B
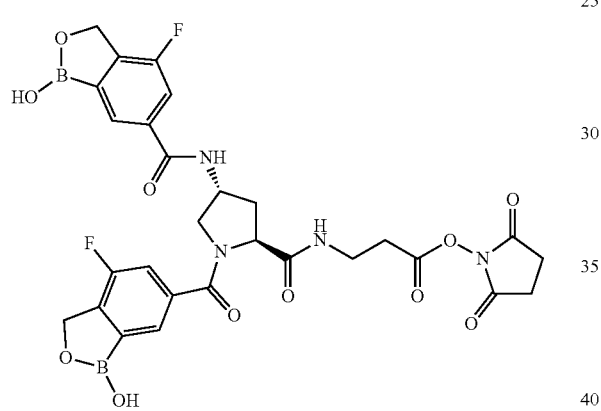
DSL-25B
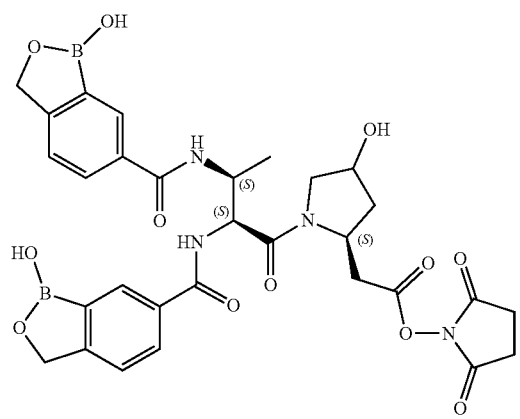
DSL-23B
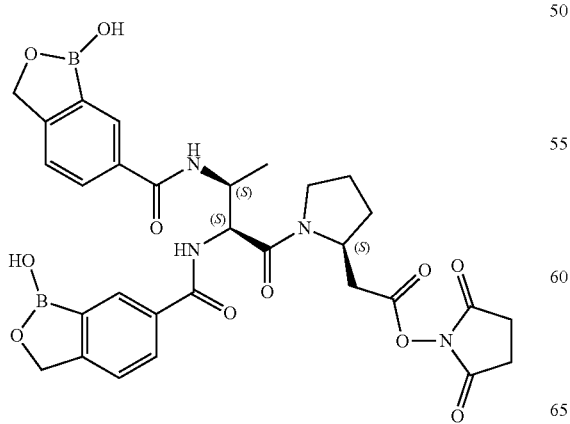
DSL-26B
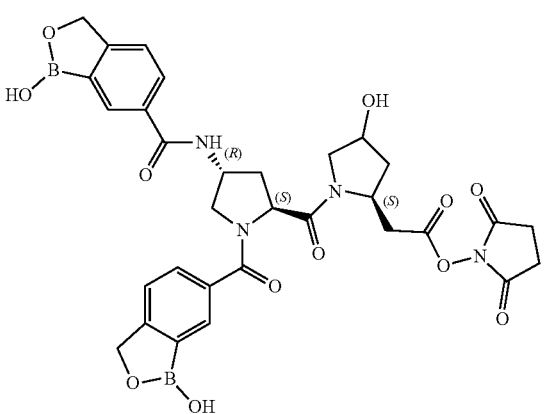

-continued
DSL-27B
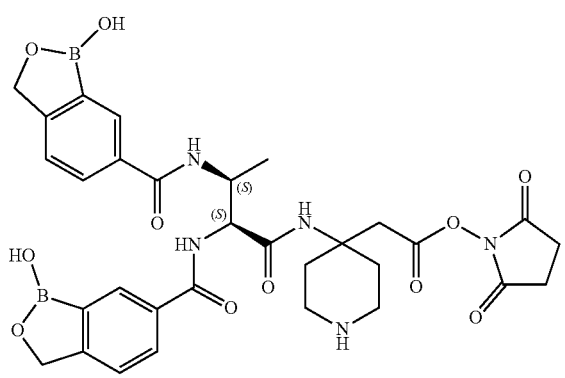
DSL-28B
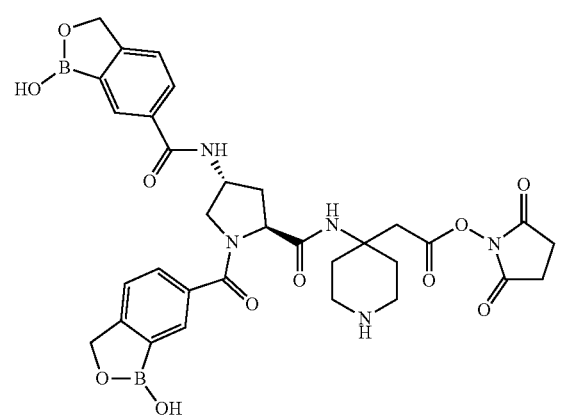
DSL-29B
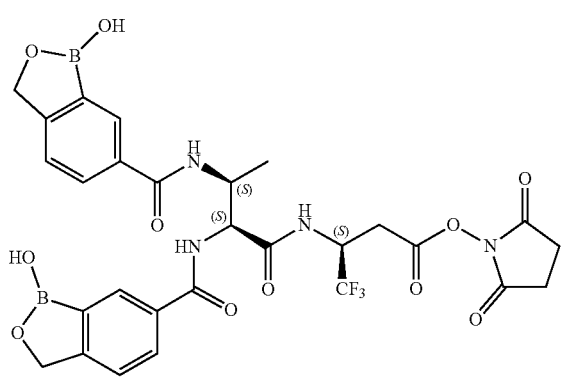
DSL-30B
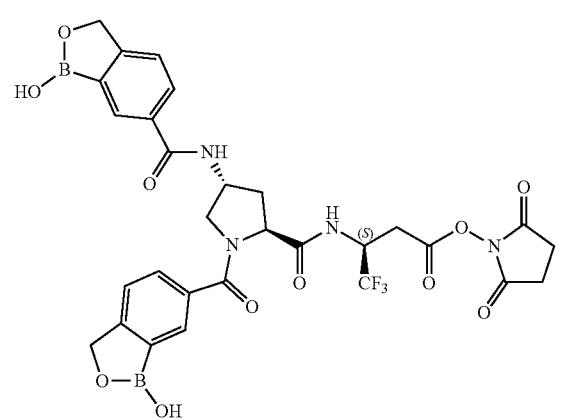
-continued
DSL-31B
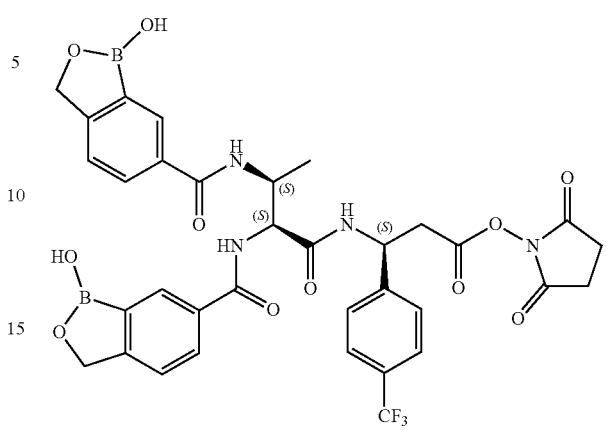
DSL-32B
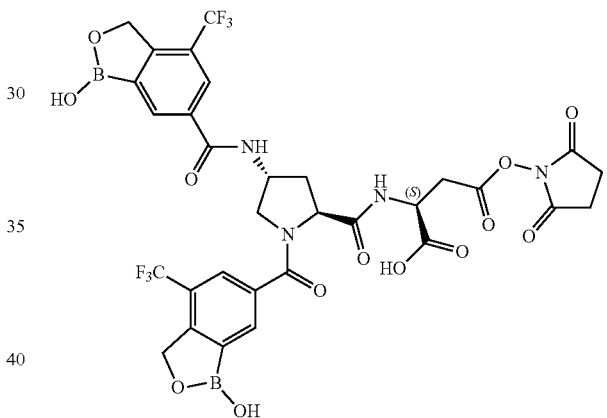
DSL-33B
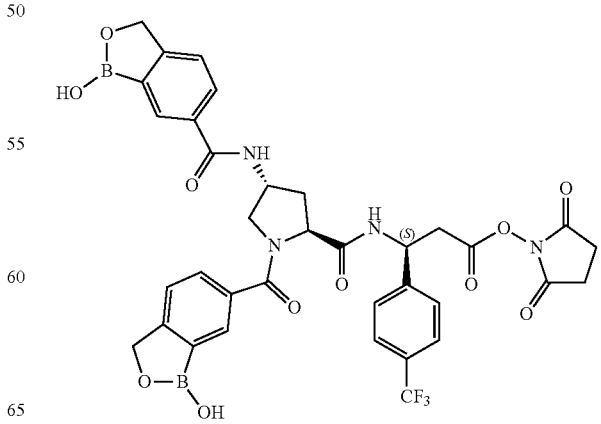

DSL-34B
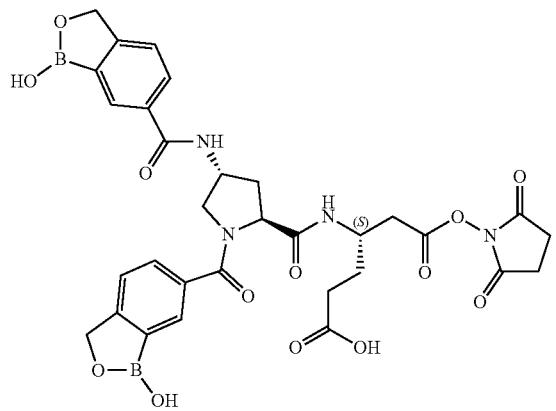
DSL-35B
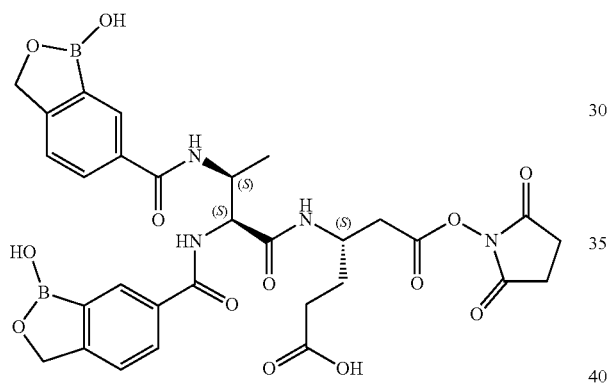
DSL-36B
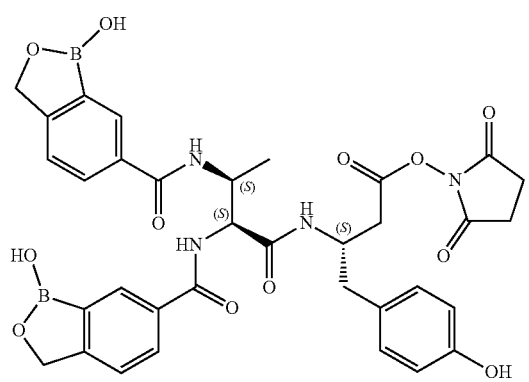
DSL-37B
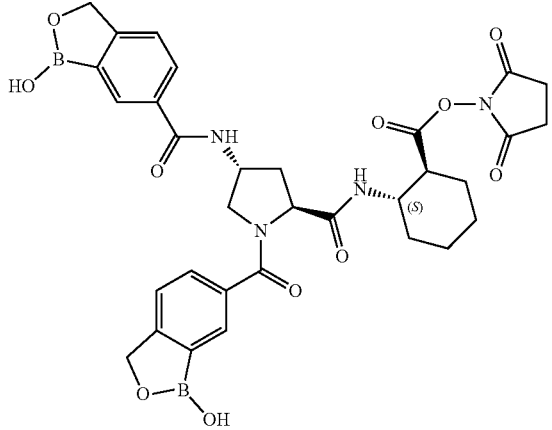
DSL-38B
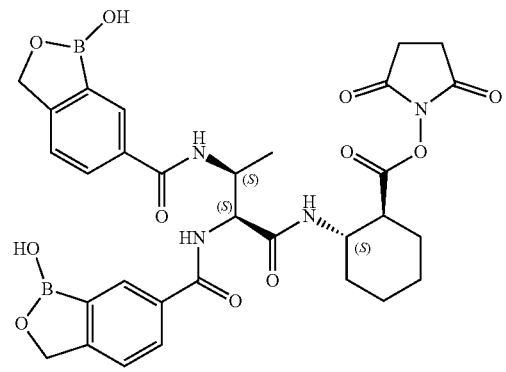
DSL-39B
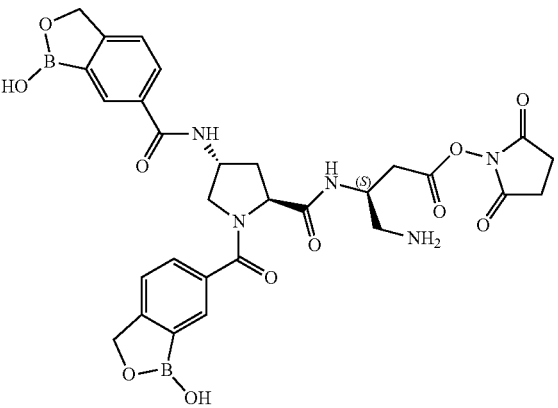

-continued
DSL-40B
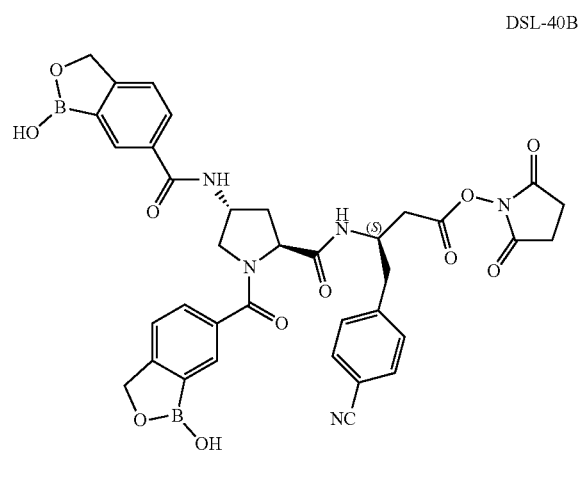
DSL-41B
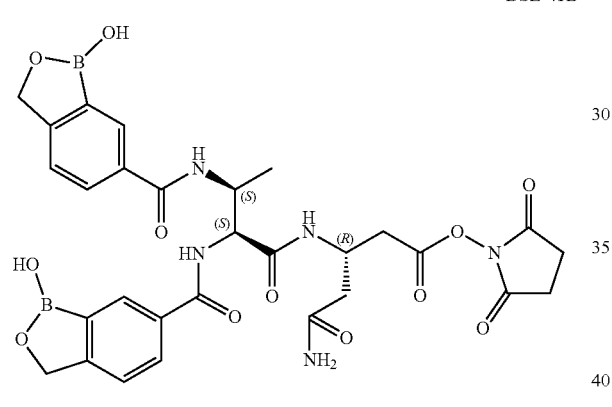
DSL-42B
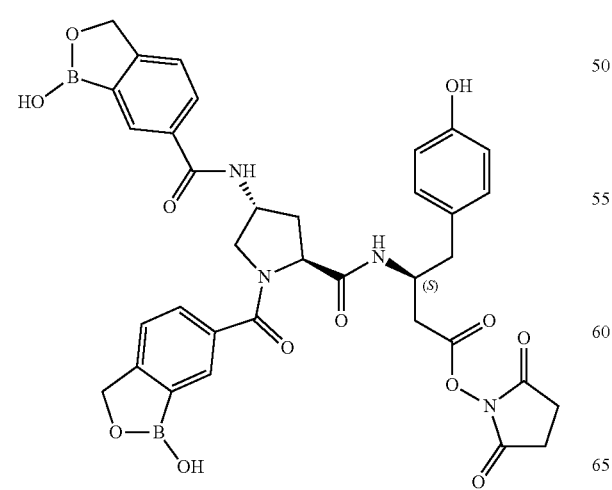
-continued
DSL-43B
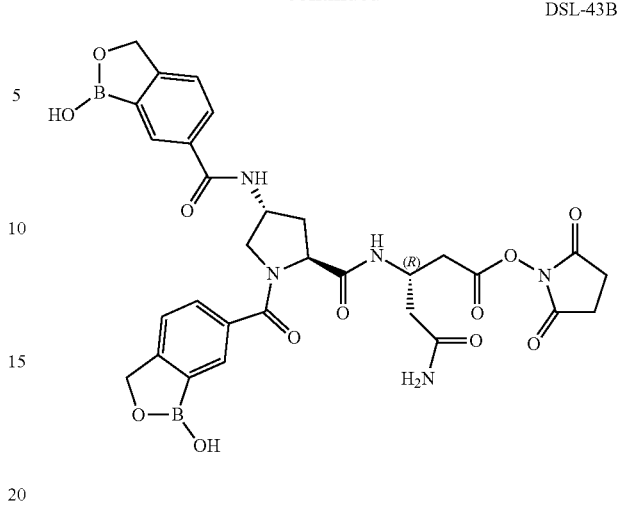
DSL-44B
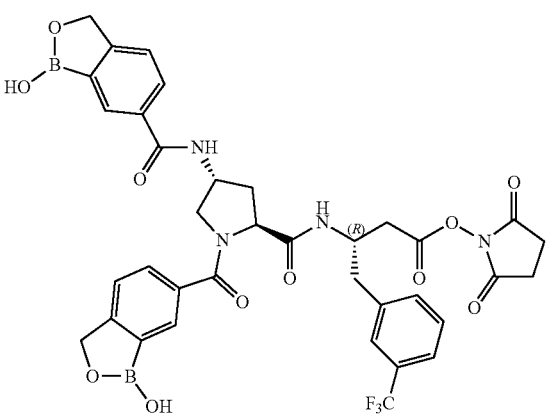
DSL-45B
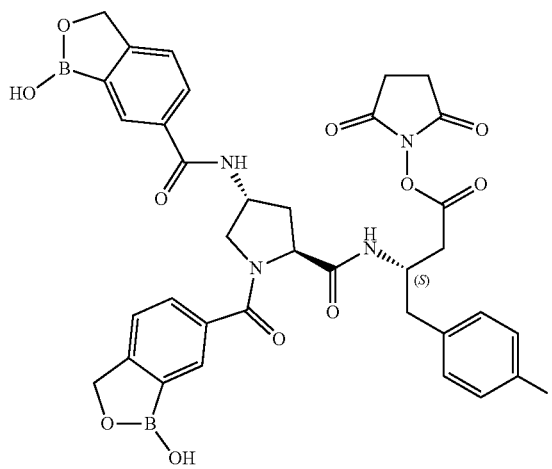

401
-continued
DSL-46B
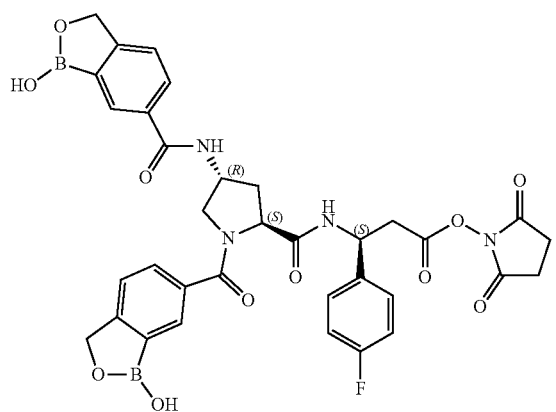
DSL-47B
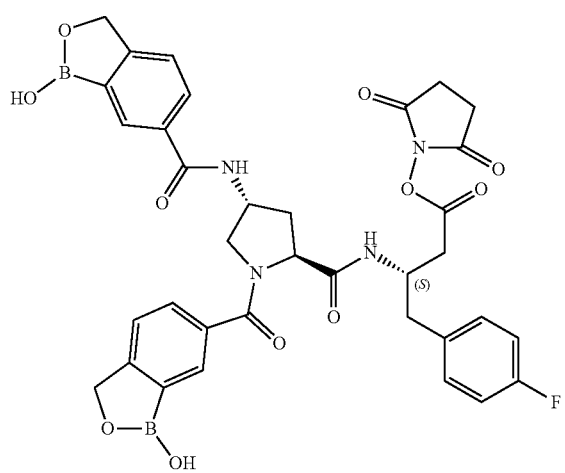
DSL-48B
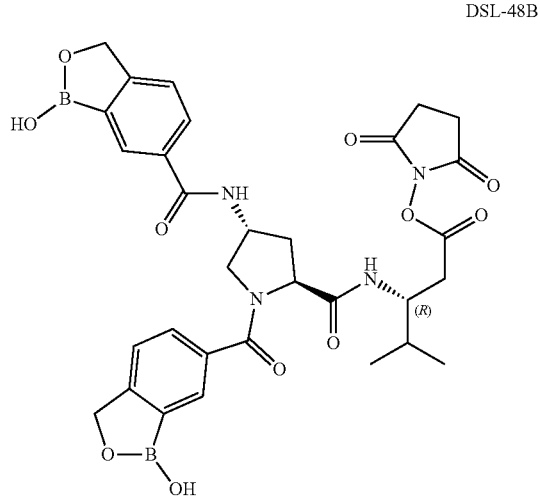
402
-continued
DSL-49B
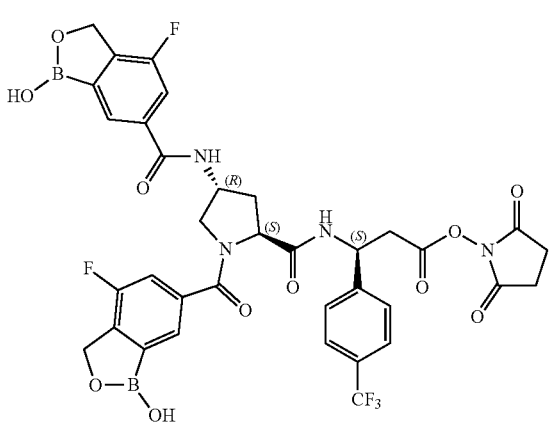
DSL-50B
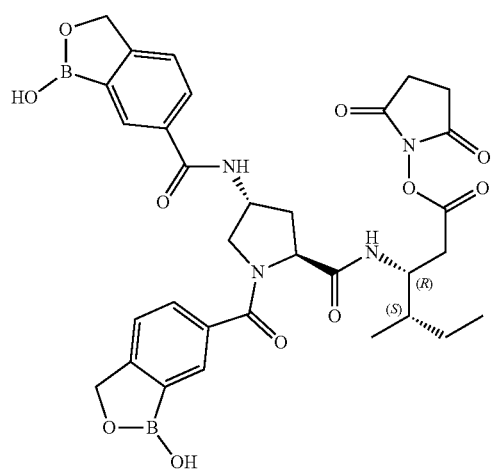
DSL-51B
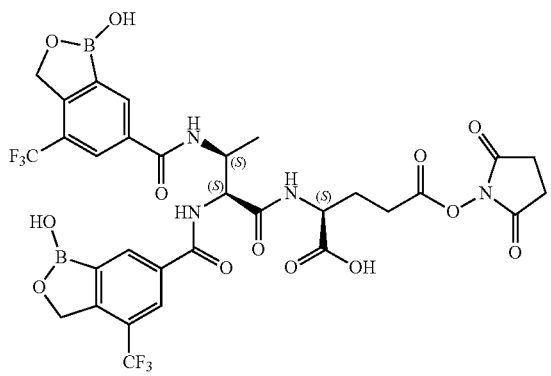

DSL-52B
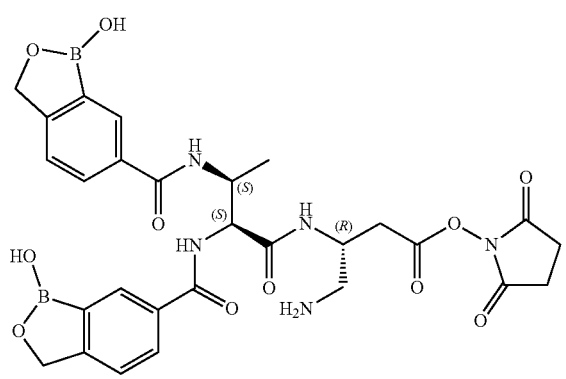
DSL-55B
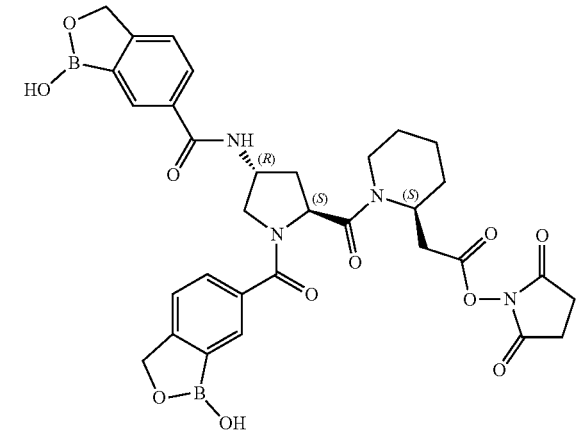
DSL-53B
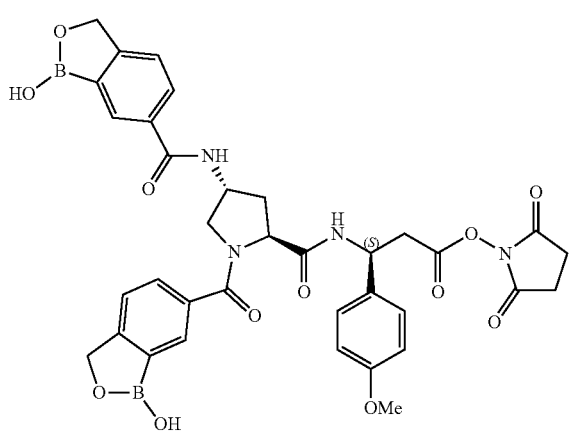
DSL-56B
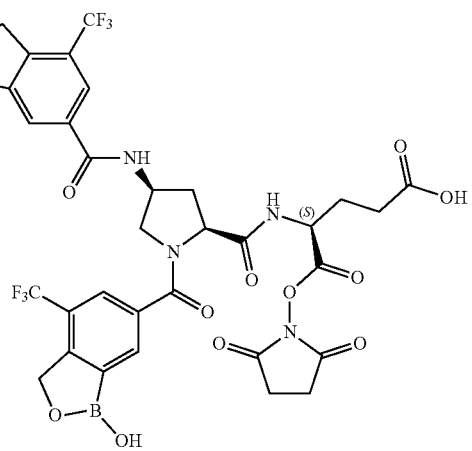
DSL-54B
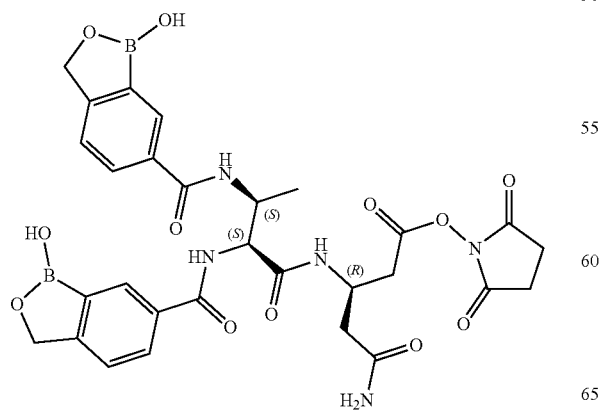
DSL-57B
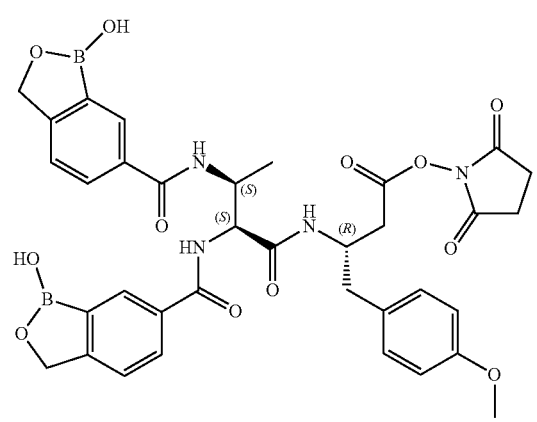

-continued
DSL-58B
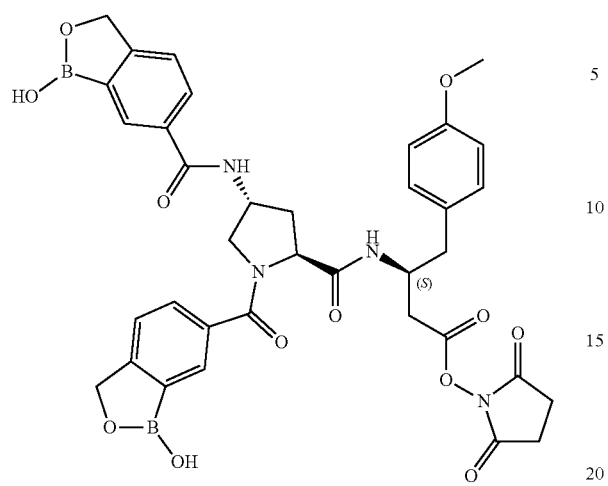
DSL-61B
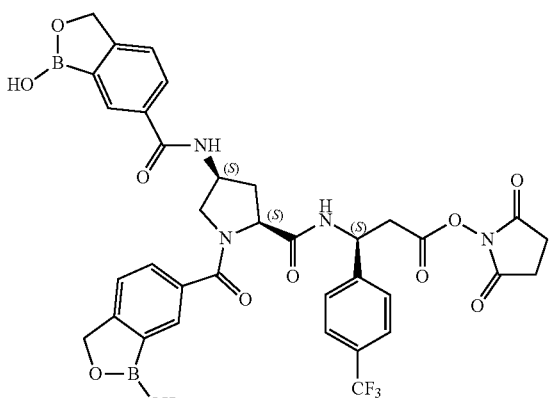
DSL-59B
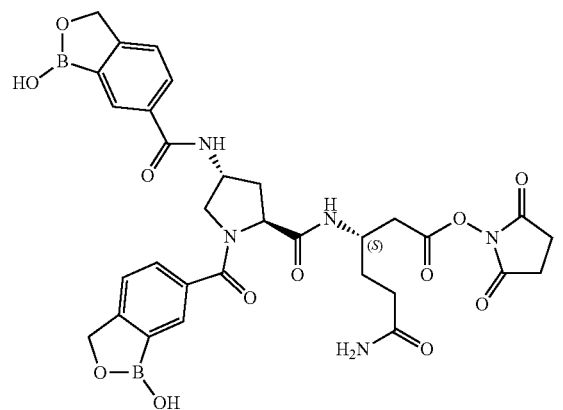
DSL-62B
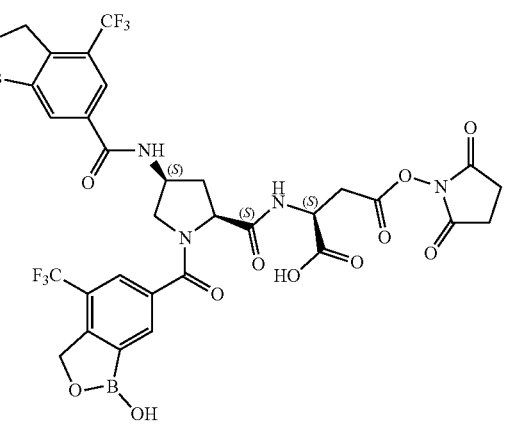
DSL-60B
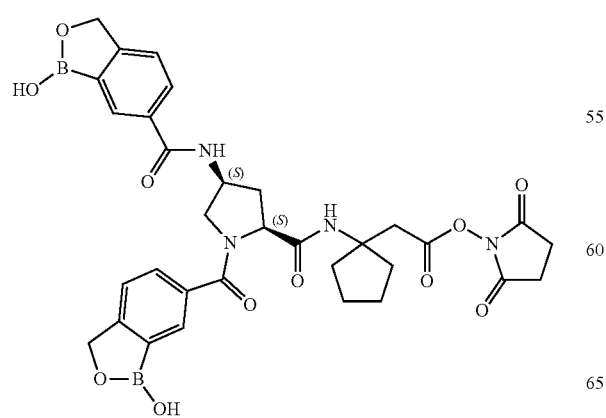
DSL-63B
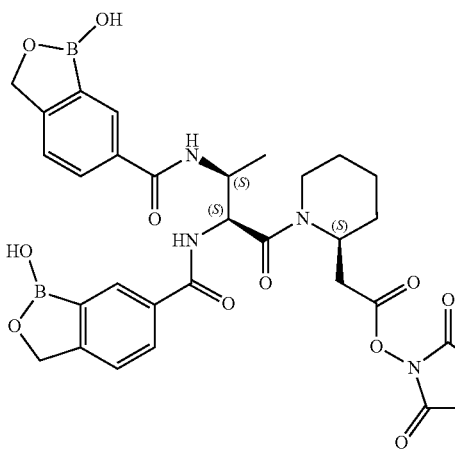

DSL-64B
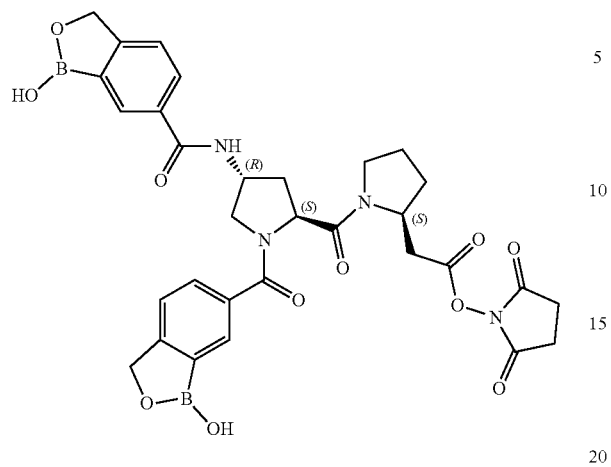
DSL-67B
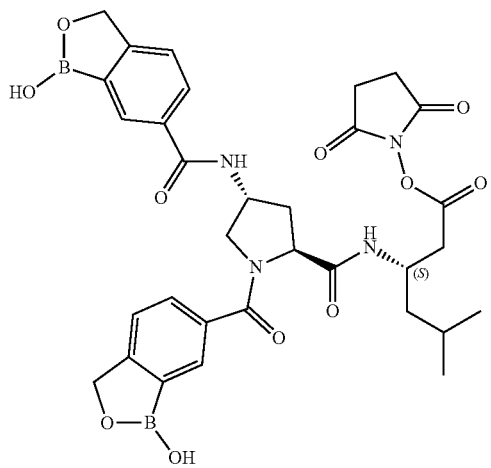
DSL-65B
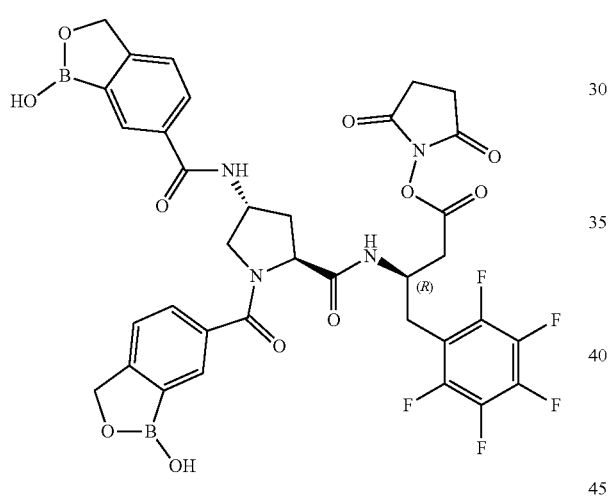
DSL-68B
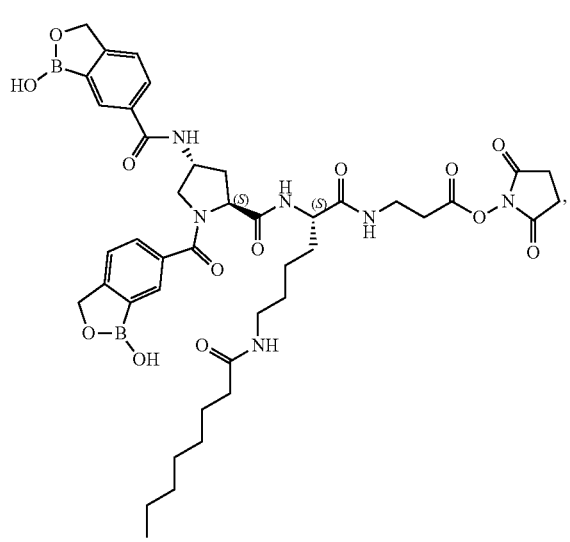
DSL-66B
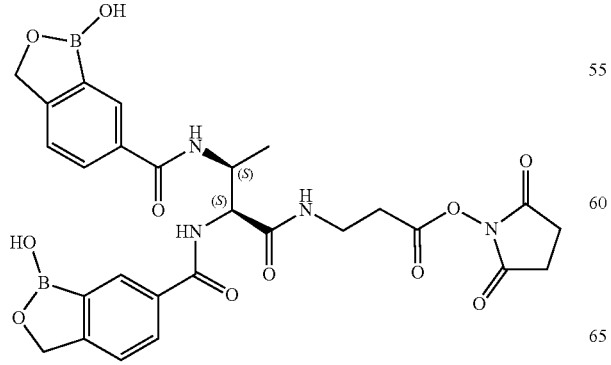
DSL-69B
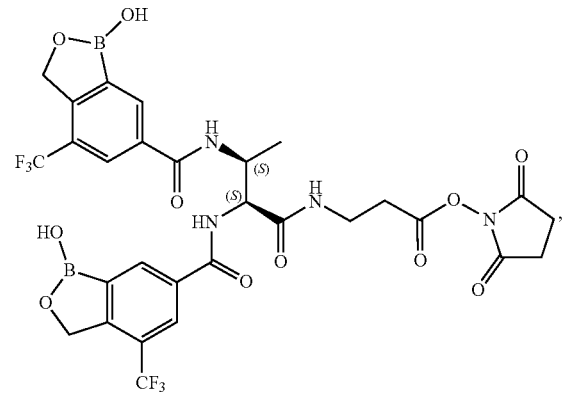

409
-continued
DSL-70B
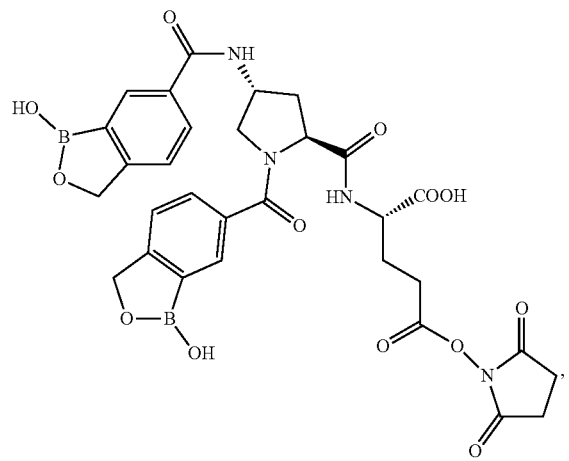
DSL-71B
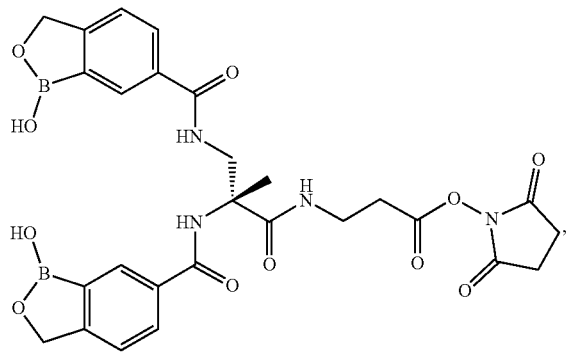
DSL-72B
DSL-73B
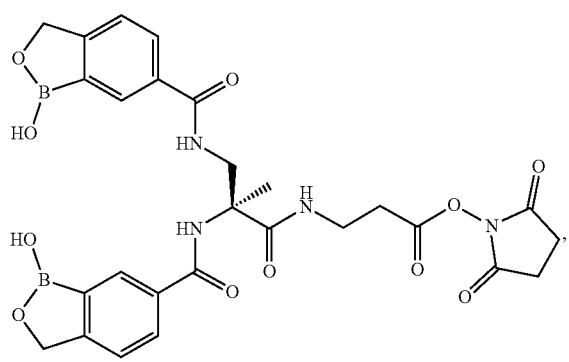
410
-continued
DSL-74B
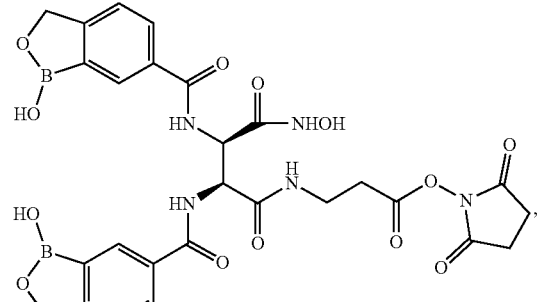
DSL-75B
DSL-76B
DSL-77B DSL-78B
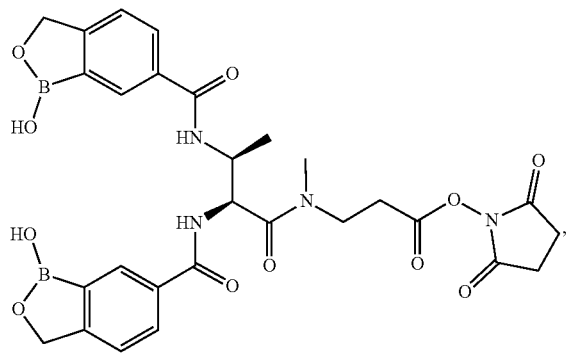
DSL-79B
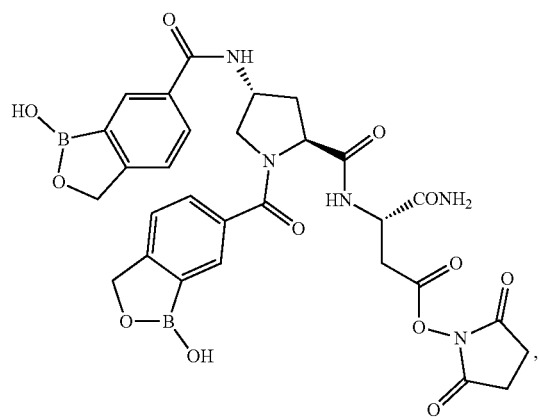
DSL-80B
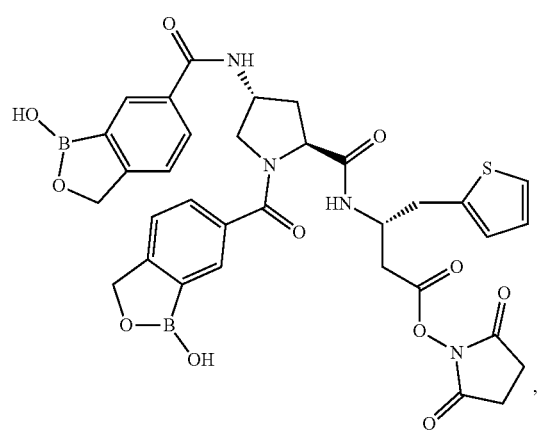
DSL-81B
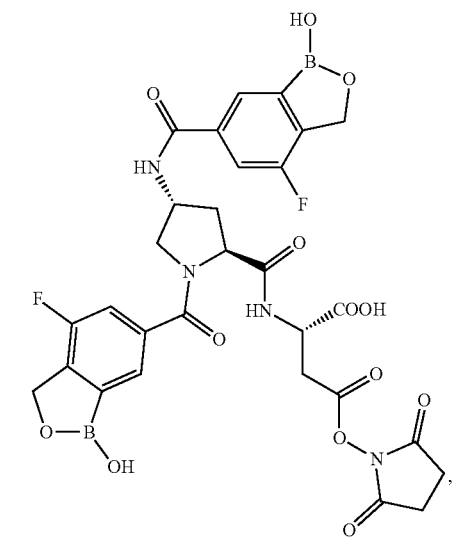
DSL-82B
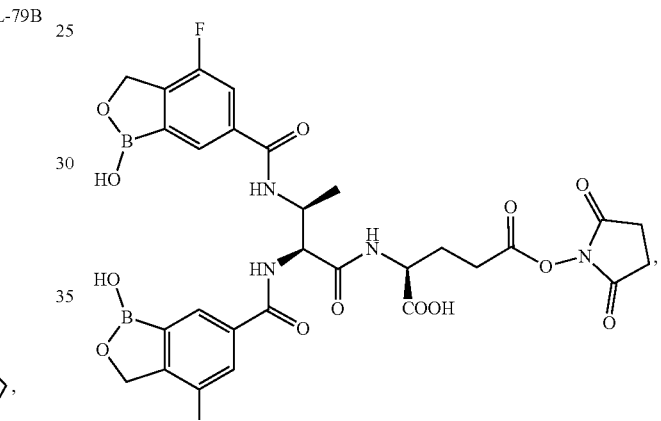
DSL-83B
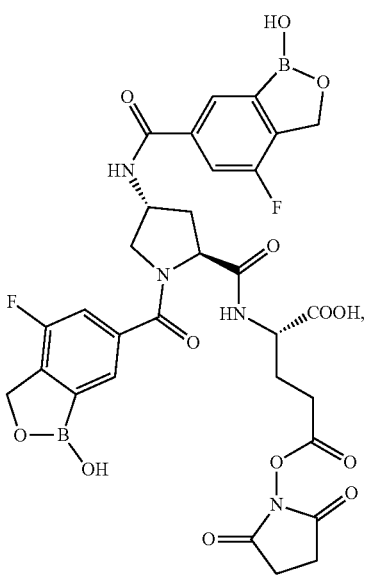

413
-continued
DSL-84B
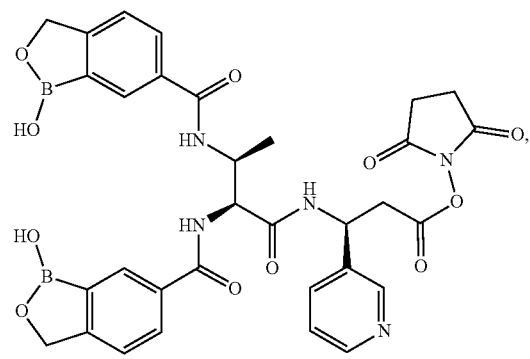
DSL-85B
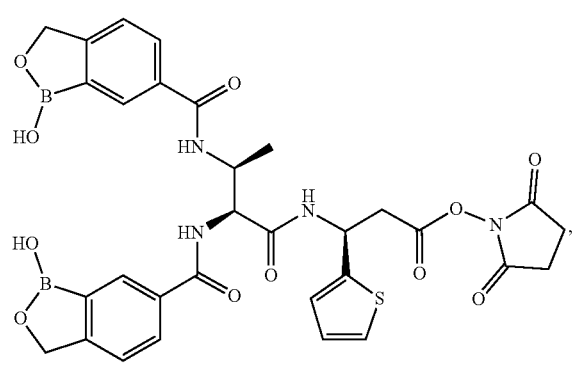
DSL-86B
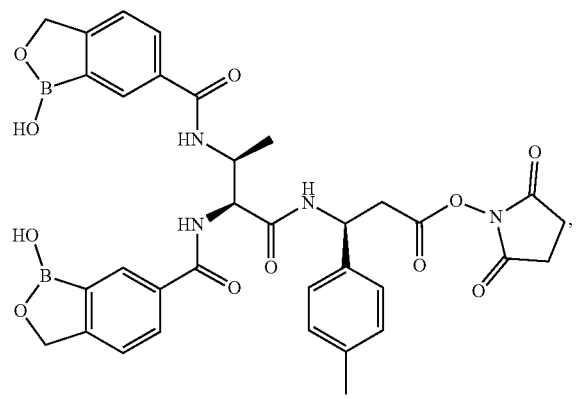
DSL-87B
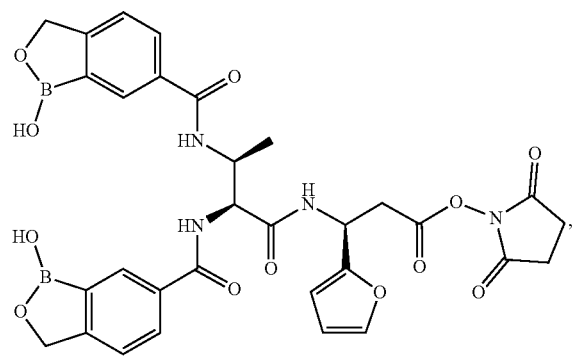
414
-continued
DSL-88B
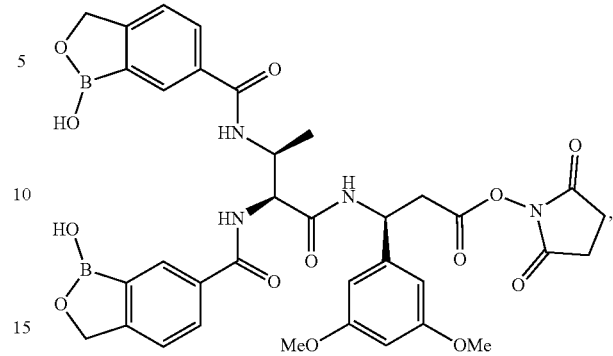
DSL-89B
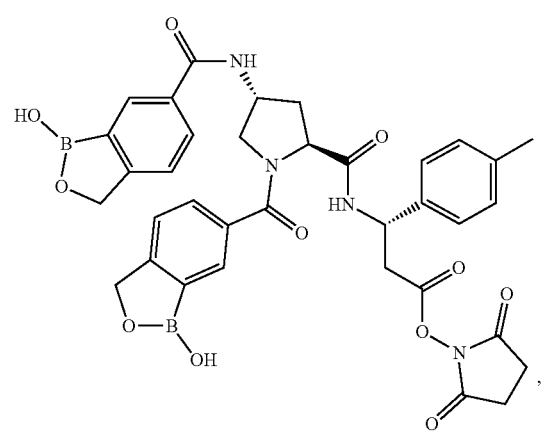
DSL-90B
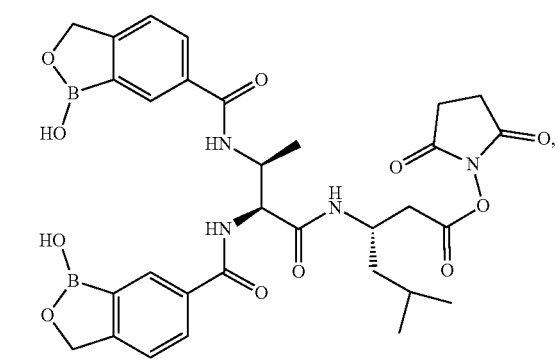
DSL-91B
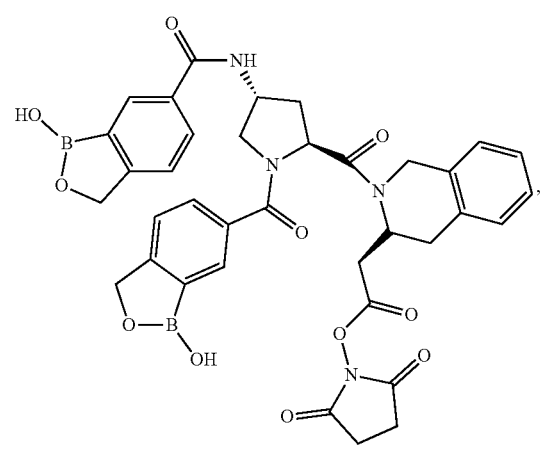

-continued
DSL-92B
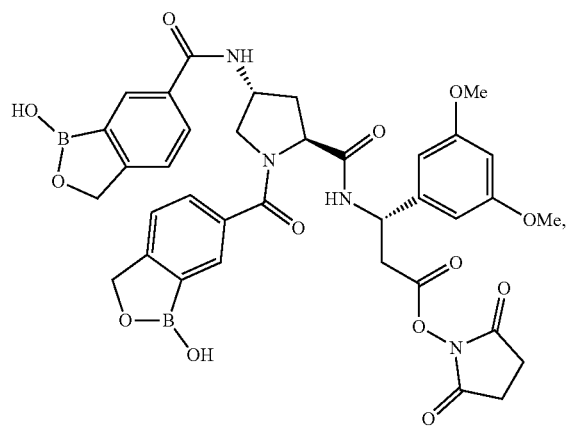
DSL-93B
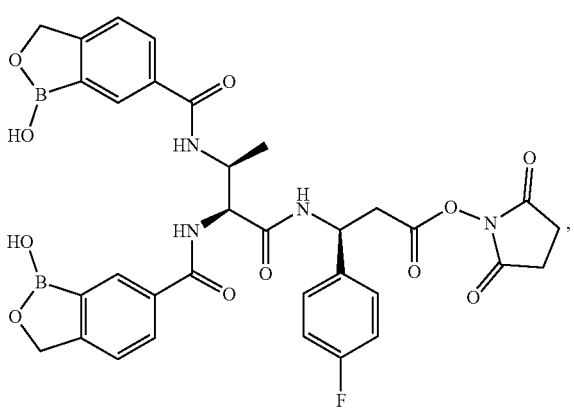
DSL-94B
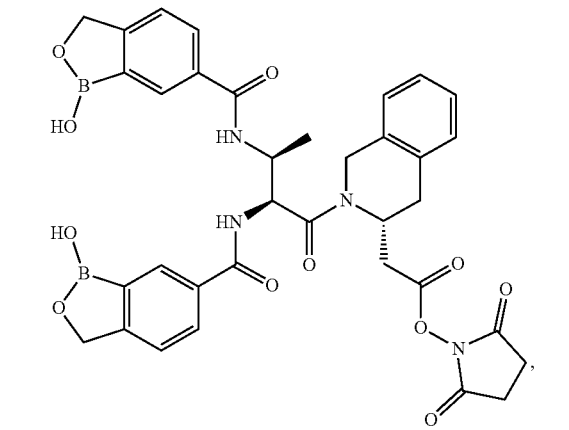
-continued
DSL-95B
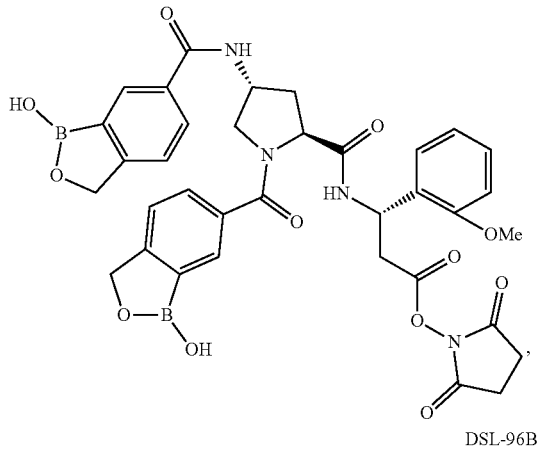
DSL-96B
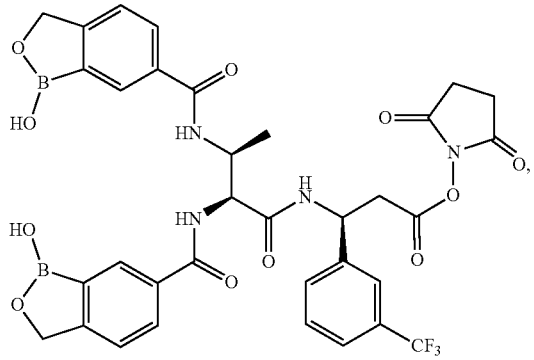
DSL-97B
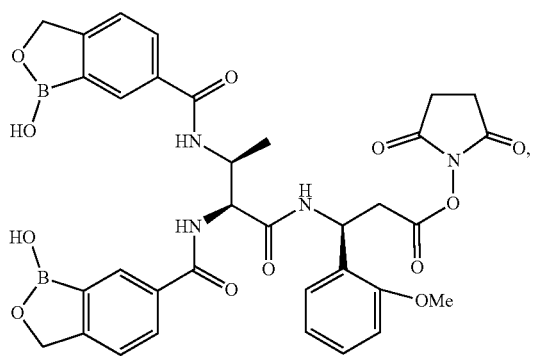
DSL-98B
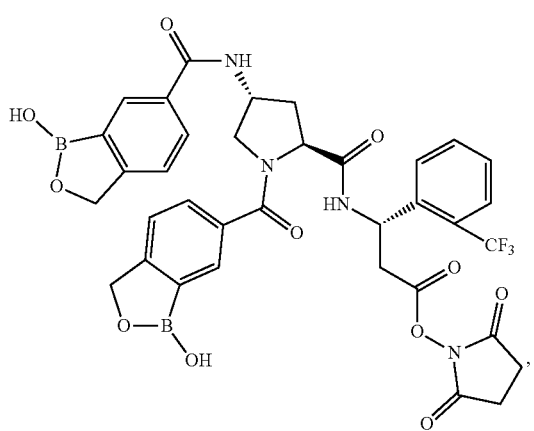

417
-continued
DSL-99B
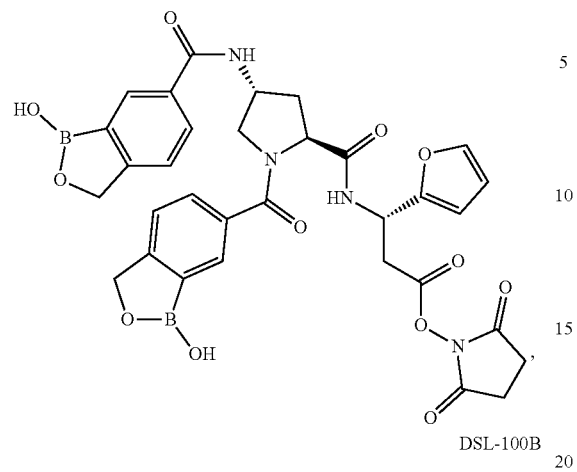
DSL-100B
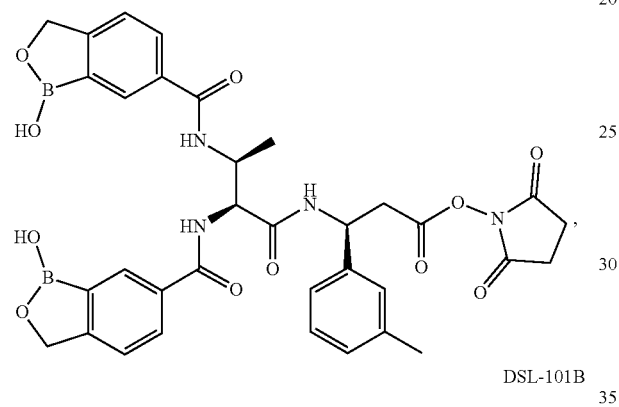
DSL-101B
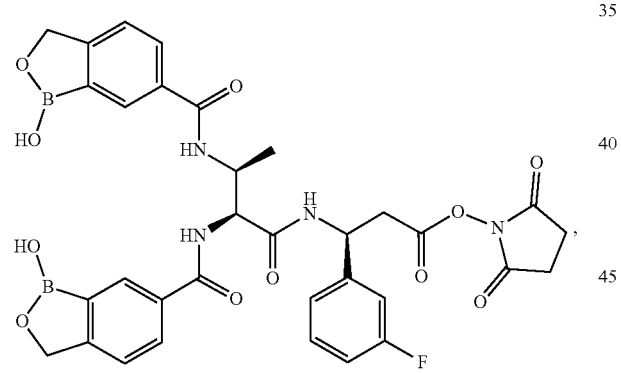
DSL-102B
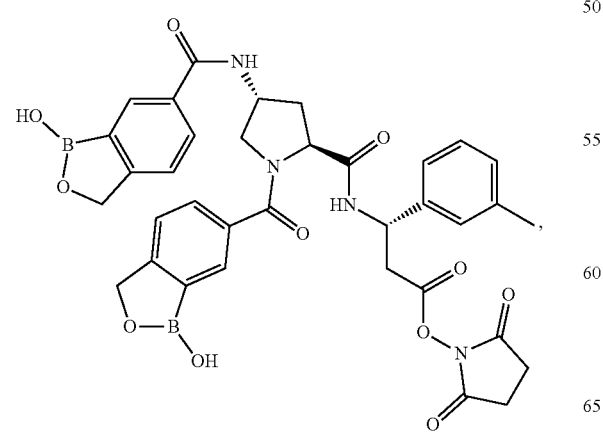
418
-continued
DSL-103B
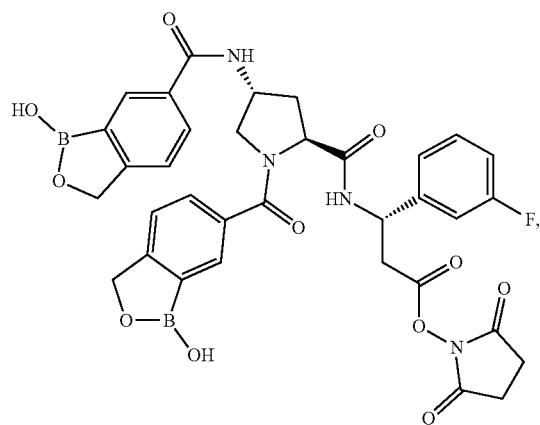
DSL-104B
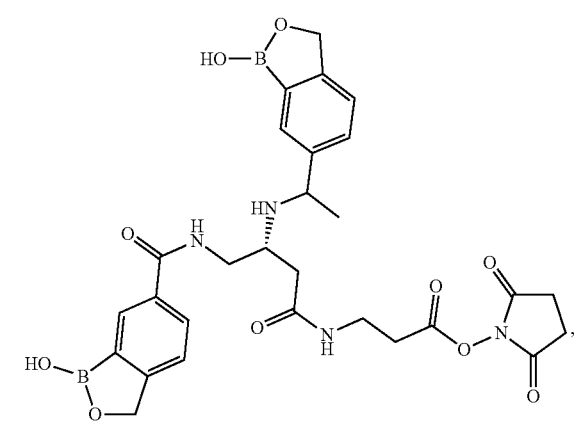
DSL-105B
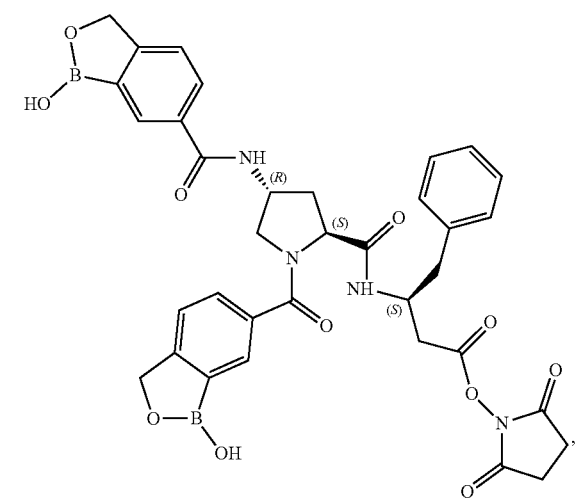

DSL-106B
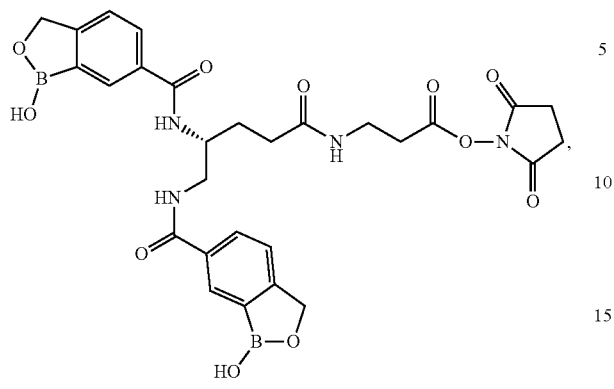
DSL-107B
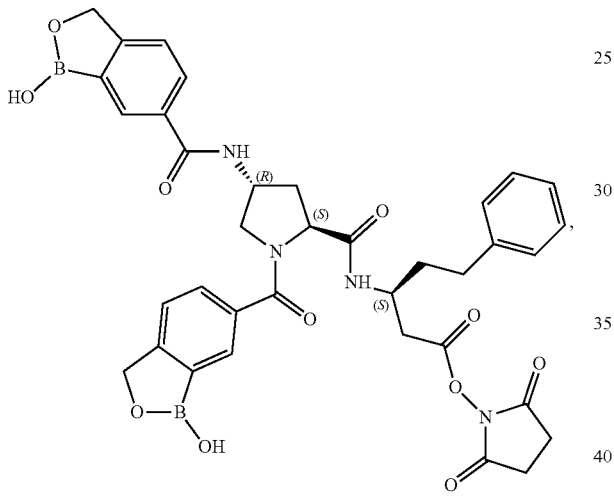
DSL-108B
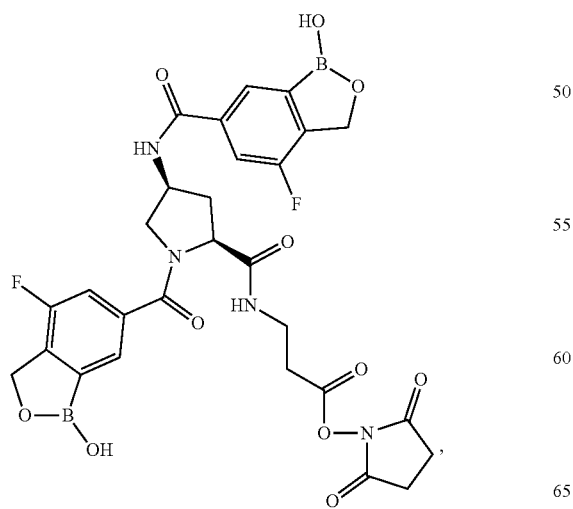
DSL-109B
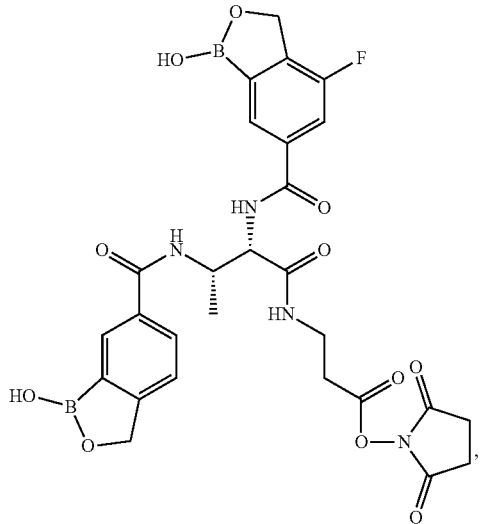
DSL-110B
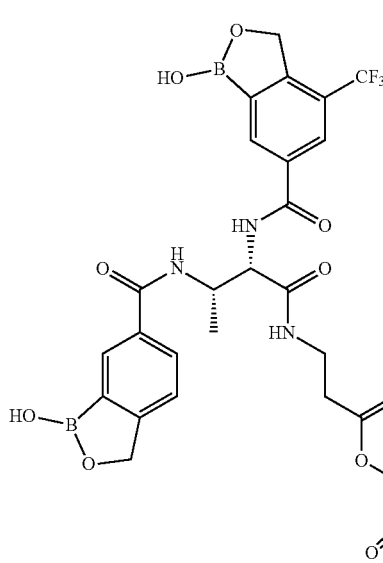
DSL-111B -continued

DSL-112B

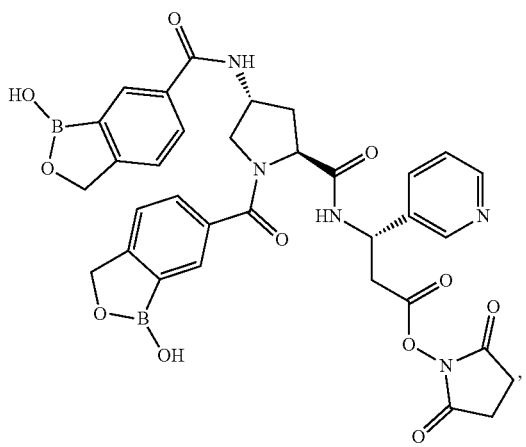

a stereoisomer or a mixture of stereoisomers, a pharmaceutically acceptable salt thereof, and combinations thereof.

In some embodiments, a therapeutically-effective amount of a pharmaceutical composition of the present disclosure may be administered to a subject. In some embodiments, the pharmaceutical composition comprises at least one compound disclosed herein (e.g., Formula I) and a pharmaceutically acceptable carrier.

In some embodiments, a compound disclosed herein is used as a medicament.

In some embodiments, the disclosure provides a method of treatment or prevention of diabetes, impaired glucose tolerance, hyperglycemia or metabolic syndrome, comprises administering to a subject in need thereof a therapeutically effective amount of a compound disclosed herein or a pharmaceutical composition disclosed herein.

In some embodiments, the pharmaceutical composition comprises one or more polyalcohols.

In some embodiments, the polyalcohols are selected from mannitol, sorbitol, erythritol, isomalt, lactitol, glucose, and maltitol.

In some embodiments, the pharmaceutical composition comprises at least one compound disclosed herein for use as a medicament for the treatment of diabetes or obesity, for control of blood sugar levels, or for control of release of a drug.

In some embodiments, the present disclosure provides a method of administering the compounds disclosed herein or a pharmaceutical composition disclosed herein to a subject as a therapeutic or prophylactic agent.

In some embodiments, the disclosure provides a method of making a compound as disclosed herein comprising at least one alkylation and/or amidation step.

In some embodiments, the disclosure provides a method of treating a subject by administering a device or formulation comprising a compound as disclosed herein, such as Examples 1-156. For example, the device can be a fixed dose injector, microdosing injector, an internal or external patch.

In some embodiments, the compound of the present disclosure may be used, as an intermediate in the manufacture of a drug substance or a therapeutic of a prophylactic compound.

In another aspect, the disclosure provides a human insulin analogue, comprising an A-chain and a B-chain, wherein the A-chain comprises a sequence selected from SEQ ID 24051 and 24052; and wherein the B-chain comprises a sequence selected from SEQ ID NOs 25000-25397.

In some embodiments, the A-chain comprises sequence 24051 and the B-chain comprises a sequence selected from 25000, 25001, 25006-25009, 25076, 25077, 25082-25085, 25228, 25229, 25232, 25234-25237, 25304, 25305, 25308, and 25310-25313.

In some embodiments, the A-chain comprises sequence 24051, and the B-chain comprises a sequence selected from 25011, 25012, 25017-25020, 25087, 25088, 25093-25096, 25229, 25239, 25232, 25240, 25245-25248, 25305, 25308, 25315, 25316, and 25321-25324.

In some embodiments, the A-chain comprises sequence 24051 and the B-chain comprises a sequence selected from 25228, 25229, 25232, 25234-25237, 25304, 25305, 25308, and 25310-25313.

In some embodiments, the A-chain comprises sequence 24051 and the B-chain comprises a sequence selected from 25011, 25012, 25017-25020, 25087, 25088, 25093-25096, 25229, 25232, 25305, and 25308.

In some embodiments, the agonist potency of a compound disclosed herein is determined by measuring the compound's potency for activation of a receptor (e.g., insulin receptor). In some embodiments, the present disclosure provides a compound having agonist potency for an insulin receptor comprising at least one aromatic boron-containing group, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 10 mM the compound has an insulin receptor agonist potency ratio of the first EC50 to the second EC50 of about 1.2 to about 14, about 1.2 to about 10, about 2 to about 9, about 2 to about 8, about 3 to about 7, or about 3 to about 6.

In some embodiments, the present disclosure is directed to a compound comprising at least one aromatic boron-containing group attached to a FF scaffold (e.g. FF116A, FF225A) comprising a methyl group, the compound having agonist potency for an insulin receptor, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 10 mM the compound has an insulin receptor agonist potency ratio of the first EC50 to the second EC50 of about 2.5 to about 3.7, about 2.5 to about 3.5, about 2.5 to about 3, or about 3 to about 3.5. In some embodiments, the methyl group is a beta methyl group, e.g. FF116A. In some embodiments, the methyl group is an alpha methyl group, e.g. FF225A.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 10 mM the compound has an insulin receptor agonist potency ratio of the first EC50 to the second EC50 of about 1 to about 15, about 1 to about 10, about 2 to about 9, about 2 to about 8, about 3 to about 7, or about 3 to about 6. In some embodiments, when the first glucose concentration is 3 mM and the second glucose concentration is 10 mM the compound has an insulin receptor agonist potency ratio of the first EC50 to the second EC50 of at least or up to about 1, 2, 3, 4, 5, 6, 7, 8, 9, 10, 11, 12, 13, 14, or 15.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 20 mM the compound has an insulin receptor agonist potency ratio of the first EC50 to the second EC50 of about 2 to about 25, about 2 to about 20, about 2 to about 15, about 2 to about 10, about 2 to about 10, about 2 to about 9, or about 2 to about 8. In some embodiments, when the first glucose concentration is 3 mM and the second glucose concentration is 20 mM the compound has an insulin receptor agonist potency ratio of the first EC50 to the second EC50 of at least or up to about 2, 3, 4, 5, 6, 7, 8, 9, 10, 11, 12, 13, 14, 15, 16, 17, 18, 19, 20, 21, 22, 23, 24, or 25.

In some embodiments, the present disclosure is directed to a compound comprising at least one aromatic boron-containing group comprising a methyl group (e.g., an alpha methyl group diboronate sensor or a beta methyl group diboronate sensor, such as DSL-9, DSL-14, DSL-18, DSL-66, DSL-69, DSL-72, DSL-75, DSL-109, DSL-110, wherein X represents a point of covalent attachment directly to the amine in X1 of Formula I) and having agonist potency for an insulin receptor, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 20 mM the compound has an insulin receptor agonist potency ratio of the first EC50 to the second EC50 of about 1.5 to about 21, about 1.6 to about 21, about 1.7 to about 20, and about 3 to about 20, about 4 to about 15, or about 10 to about 15. In some embodiments, when the first glucose concentration is 3 mM and the second glucose concentration is 20 mM the compound has an insulin receptor agonist potency ratio of the first EC50 to the second EC50 of at least or up to about 1, 2, 3, 4, 5, 6, 7, 8, 9, 10, 11, 12, 13, 14, or 15.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 3 mM and the second glucose concentration is 20 mM the compound has an insulin receptor agonist potency ratio of the first EC50 to the second EC50 of about 1 to about 25, about 2 to about 24, about 2 to about 24, about 4 to about 20, about 5 to about 18, or about 10 to about 15.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 11.1 mM the compound has an insulin receptor agonist potency ratio of the first EC50 to the second EC50 of about 1.2 to about 5, about 1.3 to about 5, about 1.4 to about 5, about 1.5 to about 5, about 2 to about 4, or about 3 to about 4. In some embodiments, when the first glucose concentration is 5.6 mM and the second glucose concentration is 11.1 mM the compound has an insulin receptor agonist potency ratio of the first EC50 to the second EC50 of at least or up to about 1.2, 1.3, 1.4, 1.5, 2, 3, 4, or 5.

In some embodiments, the present disclosure is directed to a compound comprising at least one aromatic boron-containing group comprising a methyl group (e.g., an alpha methyl group diboronate sensor or a beta methyl group diboronate sensor, such as DSL-9, DSL-14, DSL-18, DSL-66, DSL-69, DSL-72, DSL-75, DSL-109, DSL-110) having agonist potency for an insulin receptor, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 11.1 mM the compound has an insulin receptor agonist potency ratio of the first EC50 to the second EC50 of about 1.5 to about 3.5, about 1.5 to about 3, about 2 to about 3, or about 2.5 to about 3. In some embodiments, when the first glucose concentration is 5.6 mM and the second glucose concentration is 11.1 mM the compound has an insulin receptor agonist potency ratio of the first EC50 to the second EC50 of at least or up to about 1.2, 1.3, 1.4, 1.5, 2, or 3.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 11.1 mM the compound has an insulin receptor agonist potency ratio of the first EC50 to the second EC50 of about 1 to about 6, about 2 to about 6, about 3 to about 5, or about 3 to about 4. In some embodiments, when the first glucose concentration is 5.6 mM and the second glucose concentration is 11.1 mM the compound has an insulin receptor agonist potency ratio of the first EC50 to the second EC50 of at least or up to about 1, 2, 3, 4, 5, or 6.

In some embodiments, the present disclosure provides a compound comprising at least one diboronate sensor having binding affinity to glucose, wherein the compound has a glucose Kd ranging from 0.01 mM to 3 mM, 0.01 mM to 2.5 mM, 0.01 mM to 2 mM, 0.01 mM to 1.5 mM, 0.01 mM to 1 mM, or 0.01 mM to 0.5 mM. In some embodiments, the compound has a glucose Kd of less than about 3, 2.5, 2, 1.5, 1, 0.5, or 0.01 mM. In some embodiments, the compound has a glucose Kd of less than about 3, 2.5, 2, 1.5, 1, 0.5, or 0.01 mM and the compound has agonist activity for the insulin receptor.

In some embodiments, the present disclosure provides a compound comprising at least one aromatic boron-containing group having binding affinity for glucose, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of 50 to 2500 and/or a relative glucose infusion rate ratio of 0.2 to 5. In some embodiments, the compound provides a relative glucose infusion rate difference (mg/kg/min·min) of at least about 50, 100, 200, 300, 400, 500, 1000, 1500, 2000, or 2500 and/or a relative glucose infusion rate ratio of at least about 1.5, 2, 2.5, 3, 3.5, 4, 4.5, or 5.

In some embodiments, the present disclosure is directed to a compound comprising at least one aromatic boron-containing group comprising a methyl group (e.g., an alpha methyl group diboronate sensor or a beta methyl group diboronate sensor, such as DSL-9, DSL-14, DSL-18, DSL-66, DSL-69, DSL-72, DSL-75, DSL-109, DSL-110) and having agonist potency for an insulin receptor, wherein administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL, the compound has a relative glucose infusion rate difference (mg/kg/min·min) of about 700 to about 2500, about 750 to about 2500, about 800 to about 2500, about 850 to about 2500, about 900 to about 2500, and a relative glucose infusion rate ratio of about 2 to about 4, about 2 to about 3, or about 3 to about 4.

In some embodiments, the present disclosure provides a compound having agonist potency for glucose comprising at least one aromatic boron-containing group having binding affinity for glucose, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of about 1 to about 2500, about 1 to about 2000, about 1 to about 1500, about 100 to about 1500, and about 1000 to about 1500, and a relative glucose infusion rate ratio of about 0.1 to about 5, about 0.2 to about 4.5, about 0.5 to about 4, about 0.5 to about 3.5, or about 1 to about 3. In some embodiments, the compound provides a relative glucose infusion rate difference (mg/kg/min·min) of at least about 50, 100, 200, 300, 400, 500, 1000, 1500, 2000, or 2500 and/or a relative glucose infusion rate ratio of at least or up to about 2, 2.5, 3, 3.5, 4, 4.5, or 5.

In some embodiments, the present disclosure provides a compound comprising at least one aromatic boron-containing group having binding affinity for glucose, wherein when administered at a dose of 20 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of 150 to 1000 and a relative glucose infusion rate ratio of about 1 to about 3. In some embodiments, the compound provides a relative glucose infusion rate difference (mg/kg/min·min) of at least about 150, 200, 250, 300, 450, 500, 600, 700, 800, 900, or 1000, and/or a relative glucose infusion rate ratio of at least or up to about 1, 1.5, 2, 2.5, 3, 3.5, 4, 4.5, or 5.

In some embodiments, the present disclosure is directed to a compound comprising at least one aromatic boron-containing group comprising a methyl group (e.g., an alpha methyl group diboronate sensor or a beta methyl group diboronate sensor, such as DSL-9, DSL-14, DSL-18, DSL-66, DSL-69, DSL-72, DSL-75, DSL-109, DSL-110) having binding affinity for glucose. In some embodiments, the compound is administered at a dose of 20 nmol/kg to a first group of rats with a first glucose infusion rate to provide a blood glucose concentration of 100 mg/dL and to a second group of rats with a second glucose infusion rate to provide a blood glucose concentration of 200 mg/dL, the compound has a relative glucose infusion rate difference (mg/kg/min·min) of about 10 to about 1000, about 10 to about 900, about 20 to about 800, about 50 to about 700, about 100 to about 600, and about 200 to about 500, and a relative glucose infusion rate ratio of about 1 to about 2, about 1 to about 1.5, or about 2 to about 2.5.

In some embodiments, the present disclosure provides a compound having agonist potency for glucose comprising at least one aromatic boron-containing group, wherein when administered at a dose of 20 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of about 100 to about 2500, about 100 to about 1000, about 100 to about 900, about 200 to about 800, about 300 to about 700, about 400 to about 600, and about 400 to about 500, and a relative glucose infusion rate ratio of about 1 to about 2.5, about 1 to about 2, about 1 to about 1.5, about 0.5 to about 1.5, or about 1 to about 1.5.

In some embodiments, the present disclosure provides a compound having binding affinity for glucose comprising at least one aromatic boron-containing group having binding affinity to glucose, wherein when administered at a dose of 10 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of 60 to 2400 and a relative glucose infusion rate ratio of 0.5 to about 4.

In some embodiments, the present disclosure provides a compound having binding affinity for glucose comprising at least one aromatic boron-containing group comprising at least one diboronate sensor having affinity to glucose.

In some embodiments, the present disclosure is directed to a compound having agonist potency for an insulin receptor comprising at least one aromatic boron-containing group (e.g., diboronate sensor, such as DSL-1 to DSL-112), wherein one or more aromatic boron-containing groups comprise a methyl group (e.g., beta methyl, alpha methyl). In some embodiments, the compound is selected from Example 1, Example 3, Example 4, Example 5, Example 6, Example 8, Example 9, Example 10, Example 11, Example 12, Example 15, Example 16, Example 18, Example 19, Example 23, Example 24, Example 25, Example 27, Example 30, Example 33, Example 34, Example 35, Example 37, Example 40, Example 41, Example 44, Example 46, Example 48, Example 49, Example 52, Example 54, Example 55, Example 56, Example 57, Example 59, Example 64, Example 65, Example 67, Example 69, Example 70, Example 75, Example 76, Example 80, Example 82, Example 83, Example 84, Example 85, Example 92, Example 94, Example 95, Example 96, Example 97, Example 100, Example 101, Example 102, Example 104, Example 107, Example 109, Example 112, Example 113, Example 114, Example 118, Example 119, Example 122, Example 123, Example 127, Example 129, Example 130, Example 131, Example 132, Example 133, Example 140, Example 152, and Example 154. In some embodiments, at least one aromatic boron-containing group (e.g. diboronate sensor) has binding affinity to glucose. In some embodiments, a compound comprising two or more diboronate sensors has higher affinity to glucose. In some embodiments, a compound comprising three or more diboronate sensors has higher affinity to glucose.

In some embodiments, the binding constants of DSL compounds, such as DSL-1A to DSL-112A, to glucose, fructose, and/or lactate can be tested and calculated. In some embodiments, DSL compounds disclosed herein have binding affinity to glucose with a Kd value ranging from about 0.01 mM to about 3 mM. Some exemplary DSL compounds disclosed herein have binding affinity to glucose with a Kd value ranging from about 0.01 mM to about 2.5 mM. Some exemplary DSL compounds disclosed herein have binding affinity to glucose with a Kd value ranging from about 0.5 mM to about 1.5 mM. In some embodiments, exemplary DSL compounds have a binding affinity to glucose with a Kd value of less than about 3, 2.5, 2, 1.5, 1, 0.5, or 0.01 mM.

The present disclosure may also be defined according to any one of the following numbered embodiments:

1. A compound of the following formula, or a stereoisomer or a mixture of stereoisomers, or a pharmaceutically acceptable salt thereof:

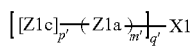

wherein:

X1 comprises a polypeptide comprising an insulin receptor agonist having an A-chain and a B-chain, wherein the A-chain comprises a sequence selected from SEQ ID NOs 1, 25, and 24051, and the B-chain comprises a sequence selected from SEQ ID NOs 24060, 24061, 24063, 25228, 25313, 25393, 25396, and 25397;

each Z1a independently comprises 1 to 50 amino acids connected together using amide or peptide bonds;

each Z1c is independently selected from Formulae FF12A, FF12B, FF114A, FF115A, FF116A, and FF225A, wherein each Z1c is covalently conjugated either directly or via an indirect linker to an amine of Z1a or to an amine of X1 or to OH when X1 is OH;

each m' is 0 or 1;

each p' is 1, 2, 3, 4, or 5; and each q' is 1, 2, 3, 4, or 5, wherein when p' or q' is 2 or more, each corresponding Z1c is independently selected and may be the same or different and wherein when q' is 2 or more, each corresponding Z1a is independently selected and may be the same or different;

when m'=0, each Z1c is covalently conjugated either directly or via an indirect linker to an amine of X1 or to OH when X1 is OH, when m'=1 each Z1a is covalently conjugated via an amide or peptide bond to X1 and each Z1c is covalently conjugated either directly or via an indirect linker to an amine of Z1a;

and wherein Formulae FF12A, FF12B, FF114A, FF115A, FF116A, and FF225A are:

FF12A
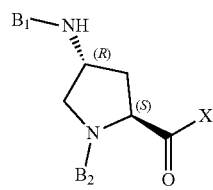

-continued

FF12B
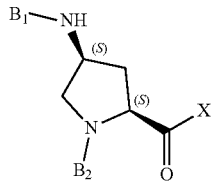

FF114A
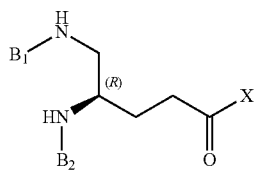

FF115A
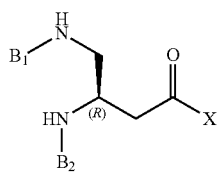

FF116A
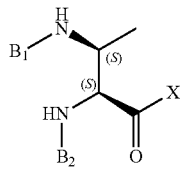

FF225A
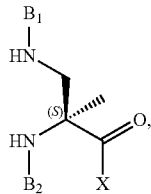

wherein X represents a point of covalent attachment either directly to an amine of X1 or to OH when X1 is OH or to an amine that is covalently conjugated directly or indirectly to X1; and wherein B1 and B2, which may be identical or different, each independently represent an aromatic boron-containing group; and wherein one or more positions of the compound may comprise an isotope.

2. The compound of embodiment 1, or a pharmaceutically acceptable salt thereof, wherein at least one Z1c comprises a beta methyl group.

3. The compound of embodiment 1, or a pharmaceutically acceptable salt thereof, wherein at least one Z1c comprises an alpha methyl group.

4. The compound of embodiment 1, or a pharmaceutically acceptable salt thereof, wherein the B1 and the B2 are each independently Formula F2, wherein Formula F2 is:

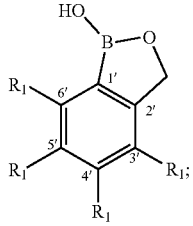
(F2)

wherein:

a first $R_1$ represents (C=O)---* or $(CH_2)_m$(C=O)---*, wherein ---* represents the attachment point to the rest of Z1c, and m is 1, 2, 3, 4, 5, 6, or 7; and each remaining $R_1$ is independently selected from H, F, Cl, Br, I, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_{m''}CH_3$, $(SO_2)NH$—$CH_3$, $(SO_2)NH(CH_2)_{m''}CH_3$, and $OCF_3$, wherein m'' is 1, 2, 3, 4, 5, 6, or 7.

5. The compound of embodiment 4, or a pharmaceutically acceptable salt thereof, wherein the first $R_1$ is (C=O)---*.

6. The compound of embodiment 4, or a pharmaceutically acceptable salt thereof, wherein (a) each remaining $R_1$ is independently selected from (i) H, $CF_3$, and F; or (b) two remaining $R_1$ are H and one remaining $R_1$ is $CF_3$ and F.

7. The compound of embodiment 6, or a pharmaceutically acceptable salt thereof, wherein each remaining $R_1$ is H.

8. The compound of embodiment 1, or a pharmaceutically acceptable salt thereof, wherein one or more Z1c is covalently conjugated via the indirect linker to X1 or to Z1a, the indirect linker is represented by Formula $(X'')_{n1}$, each n1 is independently selected from 1, 2, 3, 4, and 5, and each X'' is independently selected from Formulae FL3, FL5, FL5A, FL5B, FL21, FL25, FL33, FL41, FL59, FL60, FL64, FL65, FL68, FL69, and FL74:

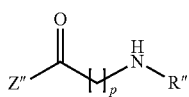
(FL3)

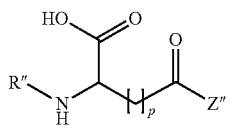
(FL5)

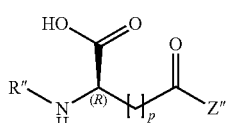
(FL5A)

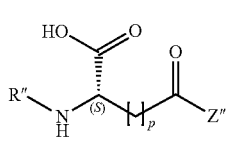
(FL5B)

-continued

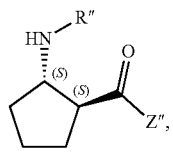
FL21

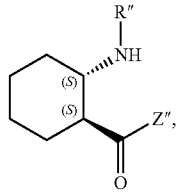
FL25

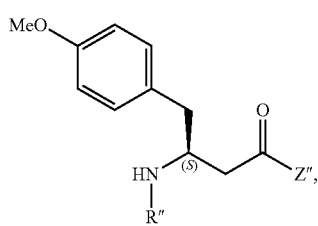
FL33

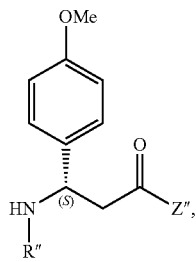
FL35

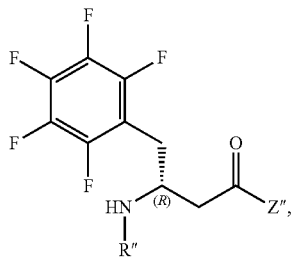
FL41

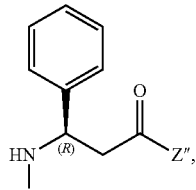
FL59

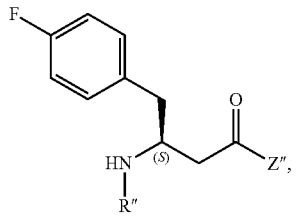
FL60

-continued

FL64
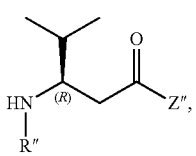

FL65
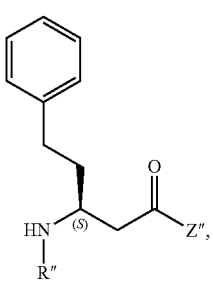

FL68
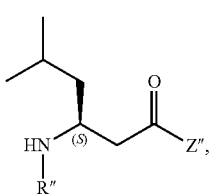

FL69
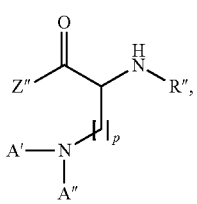

FL74
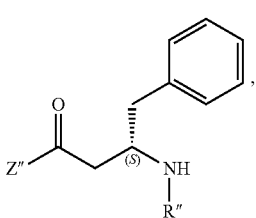

and stereoisomers thereof;
wherein:
R″ represents a covalent bond, directly or indirectly, to Z1c;
Z″ represents a covalent bond, directly or indirectly, to X1 or to Z1a;
A′ is selected from H, an alkyl group (e.g., $C_1$-$C_6$alkyl group), a saturated fatty acid, an unsaturated fatty acid, a cycloalkyl group (e.g., ($C_3$-$C_6$)cycloalkyl), a $C_1$-$C_6$ haloalkyl group, an aryl group, and a heteroaryl group; and
A″ is selected from an alkyl group (e.g., $C_1$-$C_6$alkyl group), a substituted acyl group, acyl group terminating in an acid group, a saturated or unsaturated fatty acid, a cycloalkyl group (e.g., ($C_3$-$C_6$)cycloalkyl), a haloalkyl group (e.g., $C_1$-$C_6$haloalkyl group), an aryl group, and a heteroaryl group;
p is 1, 2, 3, 4, or 5, and
any primary amine is optionally acetylated or alkylated.

9. The compound of embodiment 8, or a pharmaceutically acceptable salt thereof, wherein each said indirect linker is independently selected from FL3, FL5, FL5A, FL5B, FL33, FL64, FL65, FL69, and stereoisomers thereof.

10. The compound of embodiment 1, or a pharmaceutically acceptable salt thereof, wherein one or more Z1c is covalently conjugated to X1 via the indirect linker, and wherein the indirect linker is independently selected from Formula FL3

(FL3)
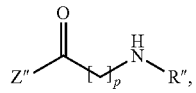

wherein p is 2 or 3; and

Formulae FL5, FL5A, and FL5B (FL5)
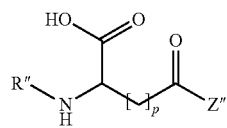

(FL5A)
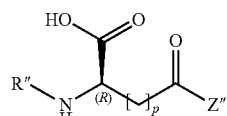

(FL5B)
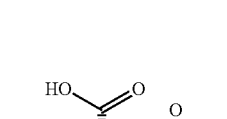

wherein p is 1 or 2.

11. The compound of embodiment 10, or a pharmaceutically acceptable salt thereof, wherein the indirect linker is selected from:

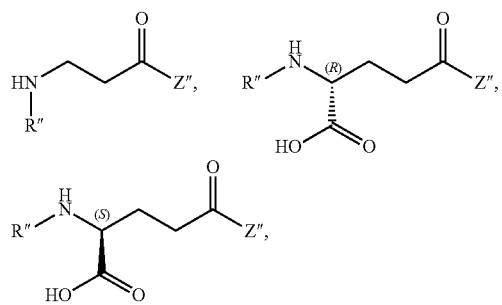

and stereoisomers thereof.

12. The compound of embodiment 1, or a pharmaceutically acceptable salt thereof, wherein each of the Z1c is covalently conjugated to the indirect linker to form a Z1c-Linker independently selected from:

-continued
DSL-9
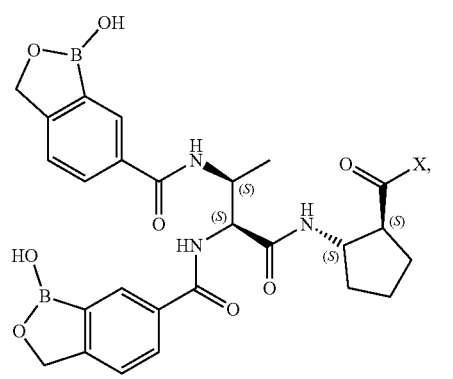
DSL-14
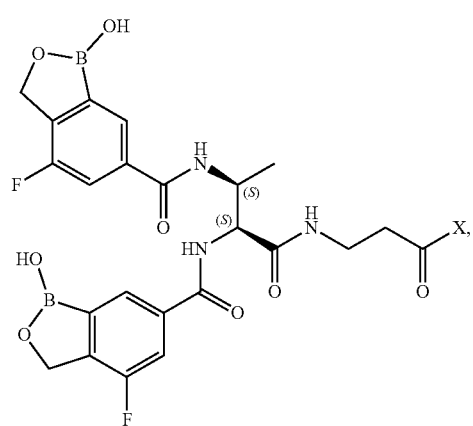
DSL-18
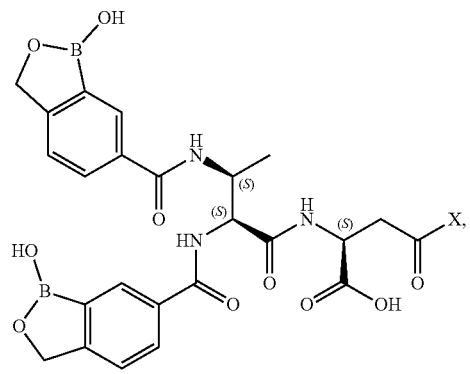
DSL-66
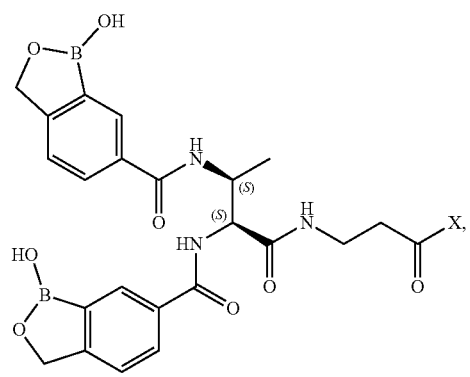
DSL-69
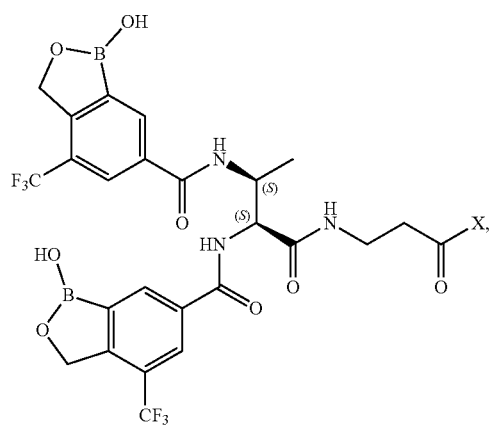
DSL-73
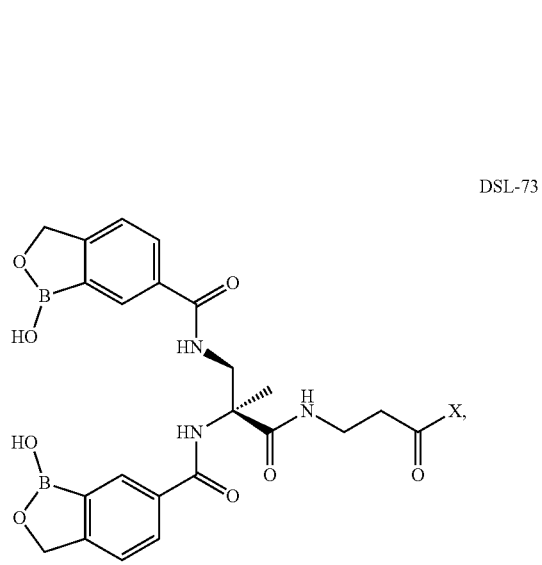
DSL-75
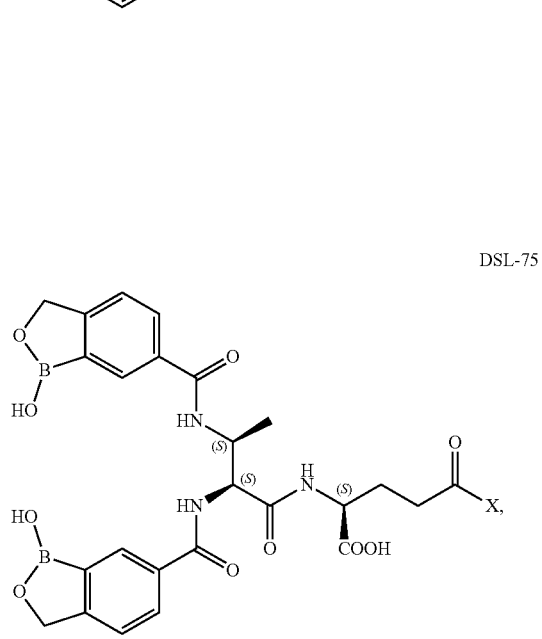

-continued

DSL-109

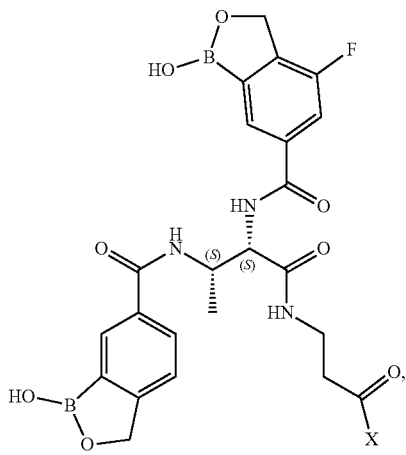

and

DSL-110

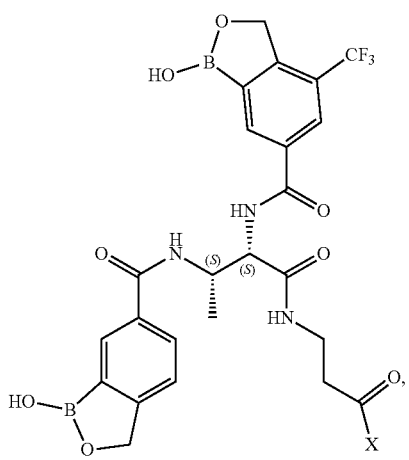

wherein X represents a point of covalent attachment directly to the amine in X1 or to OH when X1 is OH.

13. The compound of embodiment 1, wherein the compound is selected from Example 3, Example 19, Example 22, Example 23, Example 27, Example 41, Example 42, Example 44, Example 45, Example 48, Example 50, Example 55, Example 56, Example 69, Example 71, Example 76, Example 87, Example 93, Example 105, Example 131, Example 136, Example 140, Example 141, Example 142, Example 143, Example 144, Example 145, Example 146, Example 147, Example 148, Example 149, Example 151, Example 152, Example 153, Example 154, and Examples 155; a pharmaceutically acceptable salt thereof, an isotope thereof, and combinations thereof.

14. The compound of embodiment 1, wherein the compound is selected from Example 3, Example 19, Example 23, Example 27, Example 41, Example 44, Example 48, Example 55, Example 56, Example 69, Example 76, Example 131, Example 140, Example 152, Example 154, and Example 156; a pharmaceutically acceptable salt thereof, an isotope thereof, and combinations thereof.

15. A pharmaceutical composition comprising at least one compound according to embodiment 1, or a stereoisomer or a mixture of stereoisomers, or a pharmaceutically acceptable salt thereof, and a pharmaceutically acceptable carrier.

16. A pharmaceutical composition comprising at least one compound according to embodiment 13, or a pharmaceutically acceptable salt thereof, and a pharmaceutically acceptable carrier.

17. A pharmaceutical composition comprising at least one compound according to embodiment 14, or a pharmaceutically acceptable salt thereof, and a pharmaceutically acceptable carrier.

18. A method of treating diabetes, impaired glucose tolerance, hyperglycemia or metabolic syndrome, comprising administering to a subject in need thereof a therapeutically effective amount of the compound of embodiment 1, or a stereoisomer or mixture of stereoisomers, or a pharmaceutically acceptable salt thereof.

19. A method of treating diabetes, impaired glucose tolerance, hyperglycemia or metabolic syndrome, comprising administering to a subject in need thereof a therapeutically effective amount of a pharmaceutical composition according to embodiment 15.

20. A method of treating type 1 diabetes or type 2 diabetes comprising administering to a subject in need thereof a therapeutically effective amount of a pharmaceutical composition according to any one of embodiments 15-17.

21. A method of treating type 2 diabetes comprising administering to a subject in need thereof a therapeutically effective amount of a pharmaceutical composition according to embodiment 16 or 17.

22. A compound represented by Formula II, or a stereoisomer or a mixture of stereoisomers, or a pharmaceutically acceptable salt thereof:

Z1c-Linker    (Formula II)

wherein the Z1c-Linker is selected from DSL-2, DSL-8, DSL-14, DSL-18, DSL-19, DSL-21, DSL-32, DSL-37, DSL-47, DSL-48, DSL-58, DSL-65, DSL-66, DSL-67, DSL-68, DSL-69, DSL-73, DSL-75, DSL-77, DSL-83, DSL-104, DSL-105, DSL-106, DSL-107, DSL-108, DSL-109, DSL-110, DSL-111; and wherein X is a leaving group, and
wherein one or more positions of the compound of Formula II may comprise an isotope.

23. The compound of embodiment 22, wherein X is selected from N-hydroxysuccinimide (NHS), 2,3,5,6-tetrafluorophenol (TFP), pentafluorophenol (Pfp), OH, and halogen.

24. The compound of embodiment 22, wherein the compound is selected from DSL-2A, DSL-9A, DSL-14A, DSL-18A, DSL-19A, DSL-21A, DSL-32A, DSL-37A, DSL-47A, DSL-48A, DSL-58A, DSL-65A, DSL-66A, DSL-67A, DSL-68A, DSL-69A, DSL-73A, DSL-75A, DSL-77A, DSL-83A, DSL-104A, DSL-105A, DSL-106A, DSL-107A, DSL-108A, DSL-109A, DSL-110A, DSL-111A, a stereoisomer or a mixture of stereoisomers, a pharmaceutically acceptable salt thereof, and combinations thereof.

25. The compound of embodiment 22, wherein the compound is selected from DSL-2B, DSL-9B, DSL-14B, DSL-18B, DSL-19B, DSL-21B, DSL-32B, DSL-37B, DSL-47B, DSL-48B, DSL-49B, DSL-58B, DSL-65B, DSL66B, DSL-67B, DSL-68B, DSL-69B, DSL-73B, DSL-75B, DSL-77B, DSL-83B, DSL-104B, DSL-105B, DSL-106B, DSL-107B, DSL-108B, DSL-109B, DSL-110B, DSL-111B, a stereoisomer or a mixture of stereoisomers, a pharmaceutically acceptable salt thereof, and combinations thereof.

Methods of Preparation

In some embodiments, the present disclosure provides a method to prepare a compound comprising an aromatic boron-containing compound and/or an aromatic boron-containing group (e.g., Z1c, Z1c-Linker (Formula II), Formula I) or a pharmaceutical preparation comprising one or more compounds of the present disclosure.

In some embodiments, the disclosure provides a method for preparing rotationally constrained tether boron conjugates that contain scaffolds (Z1c, Z1c-Linker) that are rotationally hindered by disfavored steric interactions (e.g. gauche vs anti interactions of substituents), hindered rotation due to bond hybridization (e.g., cis- vs trans-amide rotations), or through rigid covalent bonds (e.g., (E) vs (Z) configurations for alkene moieties). For example, Formulae FF116, FF116A, FF116B, FF116C, and FF116D contain alkyl functionalities geminal (e.g., attached to the same atom) to the amine groups that are covalently conjugated to the boronic acid functionalized moieties. As another example, one or more of Formulae FF116, FF116A, FF116B, FF116C, and FF116D contain geminal alkyl substituents which may limit the accessible dihedral angles that the boron conjugated amines adopt, influencing adopted dihedral angles and placing the boronic functionalized groups closer together and allowing for increased binding of the conjugates to target molecules such as proteins or sugars.

In some embodiments, a compound as disclosed herein is further modified through connection (e.g., conjugation, fusion, etc.) to a second agent or therapy to form a fusion protein. In some embodiments, the second agent or therapy is a protein or peptide as herein described. In some embodiments, the second agent is a drug substance, wherein the drug substance is a polypeptide human hormone, an endocrine hormone, insulin, human insulin, glucagon or a glucagon analog, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, or an analogue thereof. In some embodiments, the fusion protein comprises one or more diboronate sensor(s) as described herein. In some embodiments, two or more agents are connected (e.g., conjugation, fusion, etc.) to produce a fusion protein comprising one or more diboronate sensor(s). In some embodiments, the two or more agents are proteins or peptides as herein described. The biological activity (e.g., agonist potency, bioavailability, etc.) of the compounds and compositions or methods of treatment described herein may be evaluated according to methods known by those skilled in the art. In some embodiments, the biological activity of a compound is determined by evaluating the EC50 of a compound. In some embodiments, the biological activity of a compound is determined using an insulin receptor phosphorylation (IR Phosphorylation) assay disclosed herein. In some embodiments, the biological activity of a compound is determined by evaluating the binding affinity (Kd) of a compound for its target. In some embodiments, the biological activity of a compound is determined by assessing the relative glucose rate difference. In some embodiments, the biological activity of a compound is determined by assessing the relative glucose rate ratio.

Methods of Treatment

In some embodiments, the disclosure provides a method of treating a subject suffering from, or susceptible to, a disease that is beneficially treated by a compound disclosed herein or a pharmaceutical preparation comprising one or more of the compounds disclosed herein. In some embodiments, the method comprises the step of administering to a subject in need thereof an effective amount of a pharmaceutical preparation/composition of the present disclosure. In at least one embodiment, the compound(s) and/or pharmaceutical preparations of the present disclosure may be for use in (or in the manufacture of medicaments for) the treatment or prevention of disorders, including hyperglycemia, type 2 diabetes, impaired glucose tolerance, type 1 diabetes, obesity, metabolic syndrome X, or dyslipidemia, diabetes during pregnancy, pre-diabetes, Alzheimer's disease, MODY 1, MODY 2 or MODY 3 diabetes, neurological diseases, mood disorders, and psychiatric disorders. In at least one embodiment, a therapeutically-effective amount of a compound and/or pharmaceutical preparation of the present disclosure is administered to a subject suffering from diabetes. In some embodiments, the diabetes is type 1 diabetes or type 2 diabetes. In some embodiments, the diabetes is type 1 diabetes.

In some embodiments, when a first active agent is administered with a second (another) active agent the dose may be adjusted so that the activity of the two treatments combined is sufficient to regulate blood glucose levels in a patient. Thus, the amount of a first active agent or second active agent that can be administered to regulate blood glucose levels in such combinations may be less than would be required if the first active agent or second active agent were administered as a monotherapy.

The following examples and experimental data are provided for illustrative purposes only, and do not limit the scope of the embodiments of the present disclosure.

The following abbreviations have the definitions set forth below:

| Abbreviation | Full Name |
|---|---|
| Acm | s-Acetamidomethyl group |
| ACN | Acetonitrile |
| ARS | Alizarin Red S |
| Boc | tert-Butyloxycarbonyl |
| DCM | Dichloromethane |
| Dde | 1-(4,4-dimethyl-2,6-dioxocyclohex-1-ylidene)ethyl |
| DIPEA, DIEA | N,N-Diisopropylethylamine |
| DMF | Dimethylformamide |
| DMSO | Dimethyl Sulfoxide |
| DTDP | 2,2,-Dithiopyridine |
| EDC | 3-(Ethyliminomethyleneamino)-N,N-dimethylpropan-1-amine |
| Fmoc | Fluorenylmethyloxycarbonyl Chloride |
| GLP-1 | Glucagon-Like Peptide 1 |
| HATU | Hexafluorophosphate Azabenzotriazole Tetramethyl Uronium |
| HCl | Hydrochloric Acid |
| IGF1 | Insulin-like Growth Factor 1 |
| IPTG | Isopropylthio-β-galactoside |
| IBs | Inclusion Bodies |
| LC-MS | Liquid Chromatography-Mass Spectrometry |
| MeOH | Methanol |
| MIDA | N-methyliminodiacetic acid |
| MODY | Maturity Onset Diabetes of the Young |
| NHS | N-Hydroxysuccinimide |
| Oxyma | Ethyl cyanohydroxyiminoacetate |
| RAM | Rink Amide Matrix |
| PEG | Polyethylene Glycol |
| SDS | Sodium Dodecyl Sulfate |
| tBu | tert-Butyl |
| TFA | Trifluoroacetic Acid |
| TFP | 2,3,5,6-tetrafluorophenol |
| TMB | 3,3',5,5'-tetramethylbenzidine |
| Pfp | pentafluorophenol |
| $CaCl_2$ | Calcium Chloride |
| HFIP | 1,1,1,3,3,3-Hexafluoro-2-propanol |
| $SnCl_2$ | Tin Chloride |

EXAMPLES

A. Preparation of Aromatic Boron-Containing Compounds

The disclosed compounds can be prepared according to the following schemes. The following schemes represent the general methods used in preparing these compounds. How-

DSL Synthesis Method 1

On Resin Synthesis of Diboronated Sensors

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy) carbonyl)amino)propanoic acid 2 (0.93 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL) then DMF (3×5 mL) and treated 20% piperidine with DMF for 5 minutes (3×5 mL), washed with DMF (4×5 mL). Solution of 2,3-bis((((9H-fluoren-9-yl) methoxy)carbonyl) amino)butanoic acid, 4 (0.224 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 5. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 7. The resin was washed with DMF (4×5 mL) and DCM (3×5 mL).

Cleavage of Diboronated Sensor from Resin

Compound 7 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid 8 (DSL-66A) which was used in the next step without purification.

NHS-Activation of Diboronated Sensor:

Crude diboronated sensor acid 8 was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl 3-((2S,3S)-2,3-bis(1-hydroxy-1,3-dihydrobenzo[c][1,2]oxaborole-6-carboxamido)butanamido)propanoate 11 (DSL-66B) in ~33% yield (20 mg). Calculated mass (M+H)$^+$=607.2, Observed mass (M+H)$^+$=606.9.

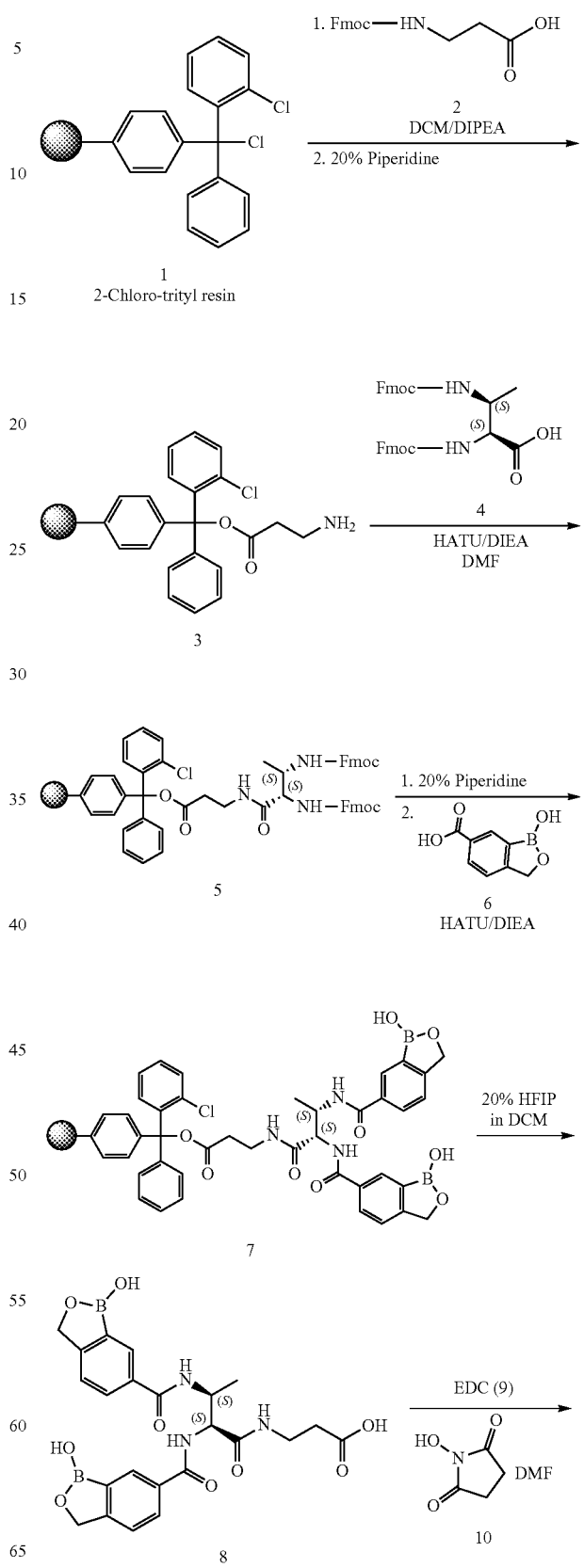

Method 1

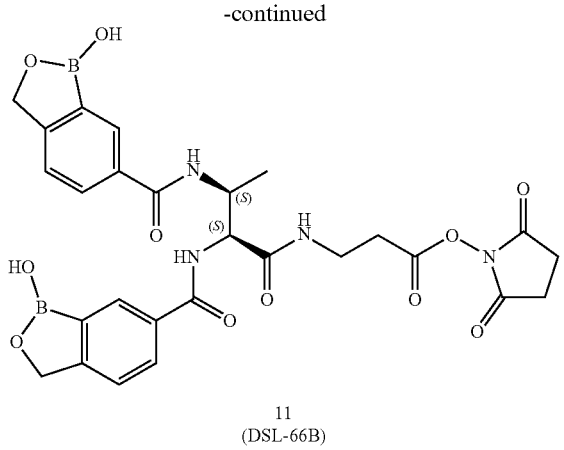

11
(DSL-66B)

The MS data for DSL-66B is listed in Table I. The other examples listed in Table I below were synthesized under similar conditions.

TABLE I

| DSL-B Examples | Mass Calculated [M + H]$^{+1}$ | Mass Observed [M + H]$^{+1}$ |
|---|---|---|
| DSL-9B | 647.24 | 647 |
| DSL-14B | 643.19 | 643.07 |
| DSL-66B | 607.20 | 607.08 |
| DSL-73B | 607.20 | |
| DSL-112B | 743.18 | 742.90 |

DSL Synthesis Method 2

On Resin Synthesis of Diboronated Sensor

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy) carbonyl) amino)propanoic acid 2 (0.93 mg, 0.3 mmol) in DCM with DIPEA (0.3 mL, 1.7 mmol)) was added immediately and gently mixed for overnight. The mixture was washed with DCM and unreacted sites were capped with a solution of 20% MeOH in a solution of DCM and DIEA (1M) and mixed for 1 hr to yield 3. The resin was washed with DCM (3×5 mL) then DMF (3×5 mL). The resin was treated 20% piperidine with DMF for 5 minutes (3×5 mL) and washed with DMF (4×5 mL). Solution of (2S,3S)-(Fmoc-amino)-3-azidobutyric acid 4 (0.146 g, 0.4 mmol), DIPEA (0.14 mL, 0.8 mmol) and HATU (0.152 g, 0.4 mmol) was added to the resin and heated at 50° C. for 30 min to give 5. Resin was washed with DMF (4×5 mL) and THF (3×5 mL) and treated with 5 mL solution of 0.2M SnCl$_2$ (189 mg), 0.8M thiophenol (440 ul) and 1M DIEA (870 ul) in THF and gently mix it for 1 hr on shaker. After 1 h, washed the resin with THF (3×5 mL) and DMF (3×5 mL). Resin was treated with 20% piperidine in DMF for 5 minutes (3×5 mL) and washed with DMF (4×5 mL) to obtain 6a. Solution of 1-hydroxy-3H-2,1-benzoxaborole-6-carboxylic acid 6 (0.178 g, 1 mmol), HATU (0.380 g, 1 mmol) and DIPEA (0.35 ml, 2 mmol) was added to the resin (6a) and heated at 50° C. for 30 min to get 7. The resin was washed with DMF (4×5 mL) and DCM (3×5 mL).

Cleavage of Diboronated Sensor from Resin

Compound 7 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid 8 (DSL-66A) which was used in the next step without purification. Similar procedures were followed for the synthesis of DSL-14A, DSL-15A, DSL-68A.

NHS-Activation of Diboronated Sensor:

Diboronated sensor acid 8 was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and then was gently mixed overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and dried under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes gave the desired product as analyzed by LCMS. Pure fractions were isolated, combined, frozen, and lyophilized to give 2,5-dioxopyrrolidin-1-yl 3-((2S,3S)-2,3-bis(1-hydroxy-1,3-dihydrobenzo [c][1,2]oxaborole-6-carboxamido)butanamido)propanoate 11 (DSL-66B) in 29% yield (17.4 mg). Calculated mass (M+H)$^+$=607.2, Observed mass (M+H)$^+$=606.9

Similar procedures were followed for the synthesis of DSL-14B, DSL-15B, and DSL-68B.

Method 2

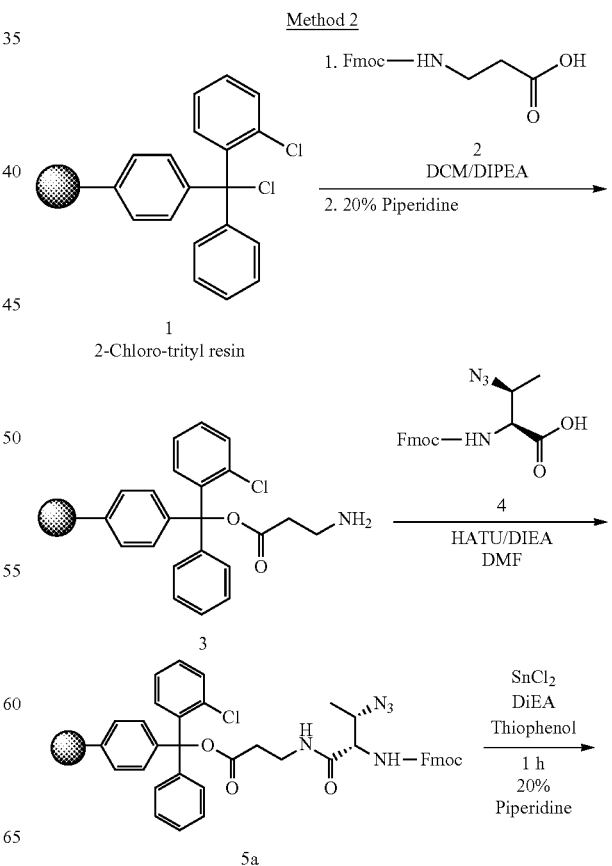

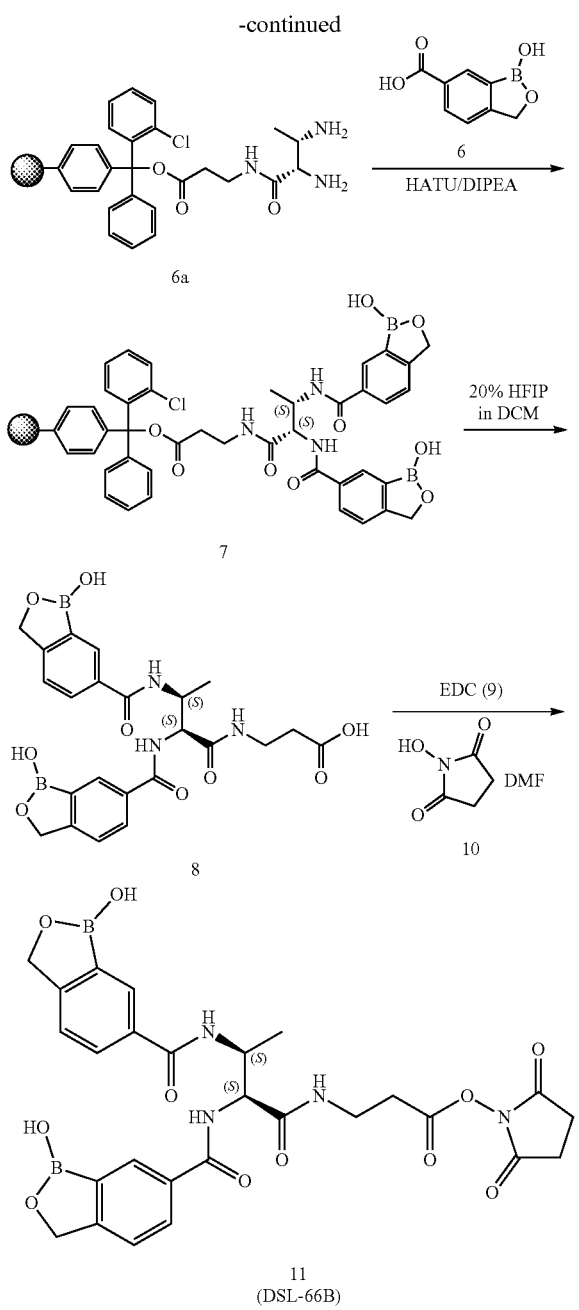

5 minutes (3×5 mL), washed with DMF (4×5 mL). Solution of (2S,4R)-1-(((9H-fluoren-9-yl)methoxy)carbonyl)-4-((((9H-fluoren-9-yl)methoxy)carbonyl)amino)pyrrolidine-2-carboxylic acid, 14 (0.229 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 42. Resin was treated with 20% piperidine in DMF for 5 minutes (3×5 mL) and washed with DMF (4×5 mL). Solution of 1-hydroxy-3H-2, 1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 43. The resin was washed with DMF (4×5 mL) and DCM (3×5 mL).

Cleavage of Diboronated Sensor from Resin

Compound 43 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-1A-OtBu which was used in the next step without purification.

NHS-Activation of Diboronated Sensor:

Crude diboronated sensor acid DSL-1A-OtBu was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum. The tert-butyl protecting group was removed with TFA in DCM (50%), allowed to mix for 1 hour, reduced under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DSL-1B as a white powder (25 mg).

DSL Synthesis Method 3

On Resin Synthesis of Diboronated Sensor

2-Chlorotrityl resin 1 (300 mg, 0.3 mmol) was swelled in dry DCM (5 mL) for 30 mins. Solvent was removed with nitrogen and a solution of (S)-3-((((9H-fluoren-9-yl)methoxy)carbonyl)amino)-4-(tert-butoxy)butanoic acid 40 (119 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 41. The resin was washed with DCM (3×5 mL) then DMF (3×5 mL) and treated with 20% piperidine in DMF for

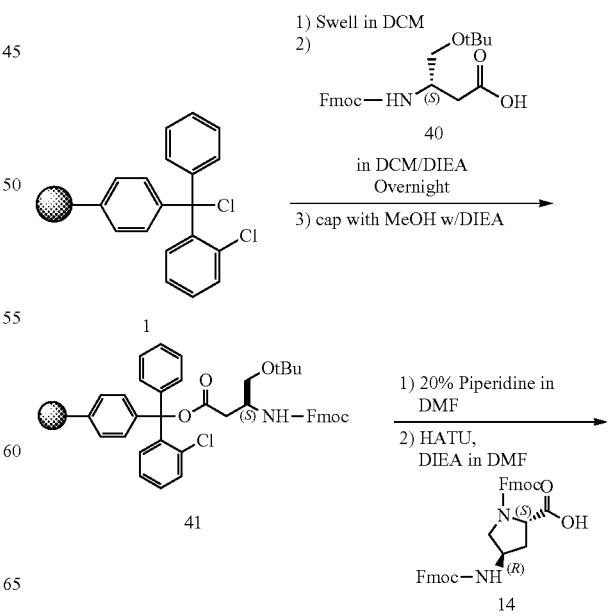

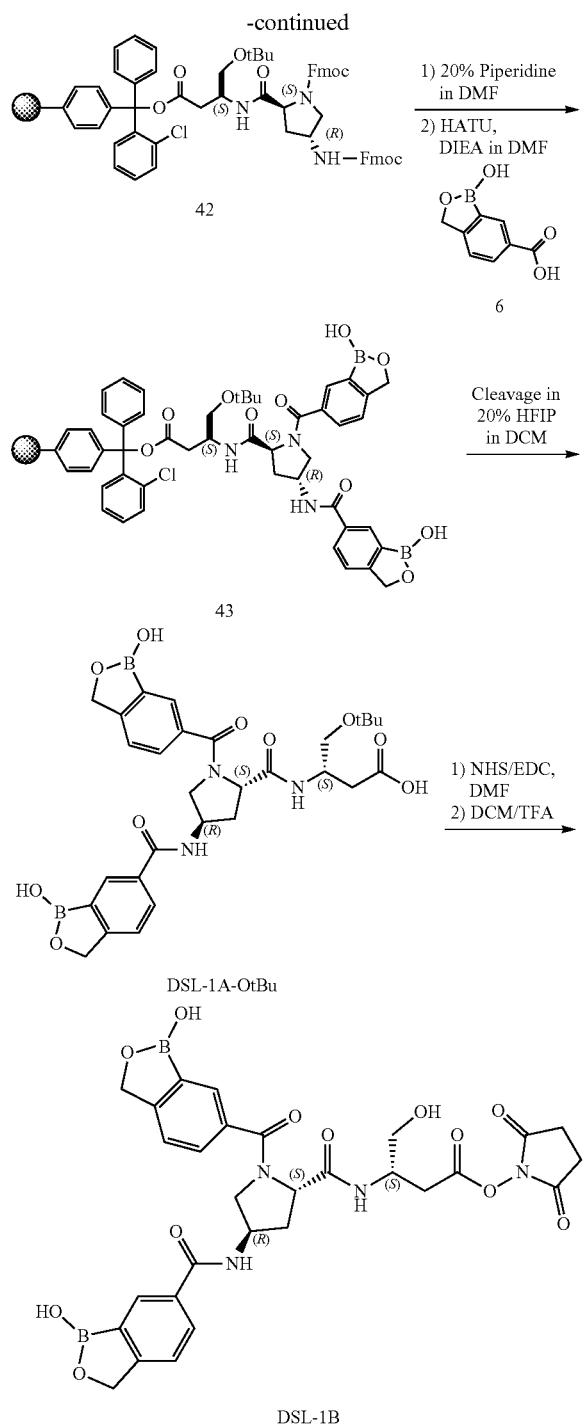

The MS data for DSL-1B is listed in Table II. The other examples listed in Table II below were synthesized under similar conditions.

TABLE II

| DSL-B Examples | Mass Calculated [M + H]$^{+1}$ | Mass Observed [M + H]$^{+1}$ |
|---|---|---|
| DSL-1B | 648.20 | |
| DSL-2B | 663.19 | 718.93 (with tBu group) |
| DSL-70B | 677.21 | 733.19 (with tBu group) |

DSL Synthesis Method 4

On Resin Synthesis of Diboronated Sensor

2-Chlorotrityl resin 1 (300 mg, 0.3 mmol) was swelled in dry DCM (5 mL) for 30 mins. Solvent was removed with nitrogen and a solution of (S)-3-((((9H-fluoren-9-yl) methoxy)carbonyl)amino)-4-(tert-butoxy)butanoic acid 40 (119 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 44. The resin was washed with DCM (3×5 mL) then DMF (3×5 mL) and treated with 20% piperidine in DMF for 5 minutes (3×5 mL), washed with DMF (4×5 mL). Solution of (2S,4R)-1-(((9H-fluoren-9-yl)methoxy)carbonyl)-4-((((9H-fluoren-9-yl)methoxy)carbonyl)amino)pyrrolidine-2-carboxylic acid, 14 (0.229 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 45. Resin was treated with 20% piperidine in DMF for 5 minutes (3×5 mL) and washed with DMF (4×5 mL). Solution of 1-hydroxy-3H-2, 1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 43. The resin was washed with DMF (4×5 mL) and DCM (3×5 mL).

Cleavage of Diboronated Sensor from Resin

Compound 45 on resin was treated with 20% 1,1,1,3,3, 3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-15A-OtBu which was used in the next step without purification.

NHS-Activation of Diboronated Sensor:

Crude diboronated sensor acid DSL-15A-OtBu was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and evaporated under vacuum. The tert-butyl protecting group was removed with TFA in DCM (50%), allowed to mix for 1 hour, reduced under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DSL-15B as a white powder (21 mg).

Method 1

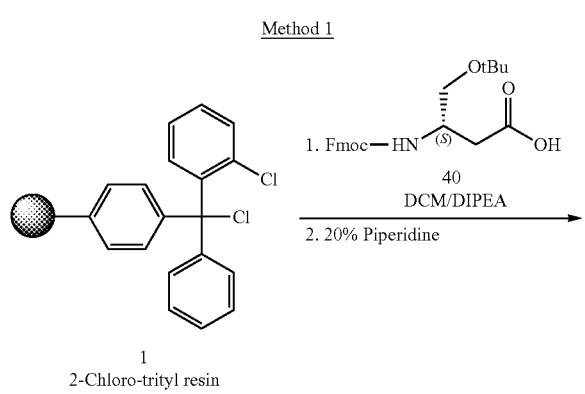

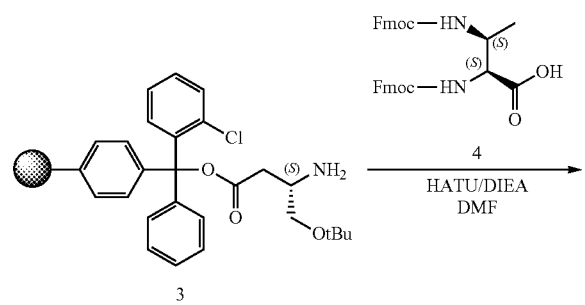

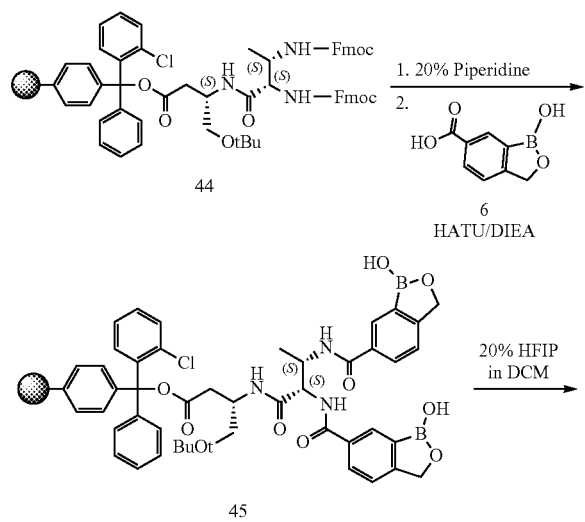

DSL-15A-OtBu

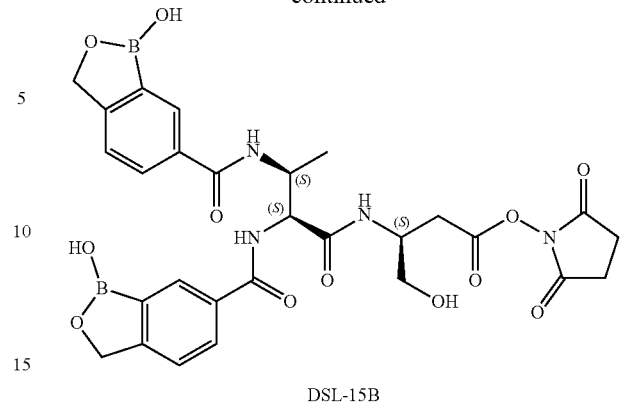

DSL-15B

The MS data for DSL-15B is listed in Table III. The other examples listed in Table III below were synthesized under similar conditions.

TABLE III

| DSL-B Examples | Mass Calculated $[M + H]^{+1}$ | Mass Observed $[M + H]^{+1}$ |
| --- | --- | --- |
| DSL-15B | 636.20 | |
| DSL-51B | 801.18 | 856.45 (with tBu group) |
| DSL-75B | 665.21 | 734.75 (with tBu gropu) |

DSL Synthesis Method 5

On Resin Synthesis of Diboronated Sensor

2-Chlorotrityl resin 1 (300 mg, 0.3 mmol) was swelled in dry DCM (5 mL) for 30 mins. Solvent was removed with nitrogen and a solution of (R)-3-((((9H-fluoren-9-yl)methoxy)carbonyl)amino)-5-methylhexanoic acid 12 (110 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 13. The resin was washed with DCM (3×5 mL) then DMF (3×5 mL) and treated with 20% piperidine in DMF for 5 minutes (3×5 mL), washed with DMF (4×5 mL). Solution of (2S,4R)-1-(((9H-fluoren-9-yl)methoxy)carbonyl)-4-((((9H-fluoren-9-yl)methoxy)carbonyl)amino)pyrrolidine-2-carboxylic acid, 14 (0.229 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 15. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 16. The resin was washed with DMF (4×5 mL) and DCM (3×5 mL).

Cleavage of Diboronated Sensor from Resin

Compound 16 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-67A which was used in the next step without purification.

5b: NHS-Activation of Diboronated Sensor:

Crude diboronated sensor acid DSL-67A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-5-methylhexanoate DSL-67B in ~28% yield (18.7 mg). Calculated mass $(M+H)^+$=675.2, Observed mass $(M+H)^+$=675.0.

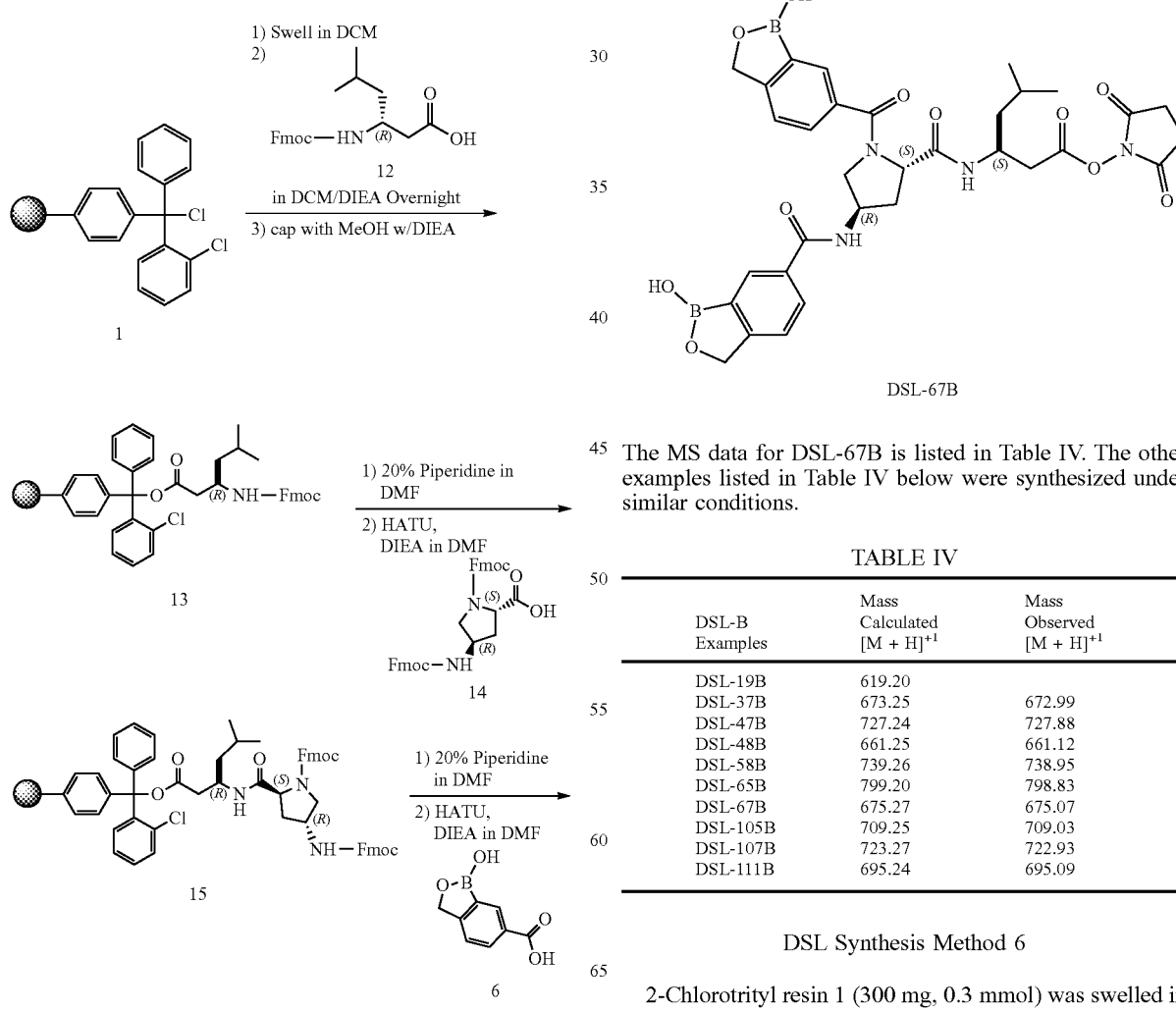

The MS data for DSL-67B is listed in Table IV. The other examples listed in Table IV below were synthesized under similar conditions.

TABLE IV

| DSL-B Examples | Mass Calculated $[M + H]^{+1}$ | Mass Observed $[M + H]^{+1}$ |
| --- | --- | --- |
| DSL-19B | 619.20 | |
| DSL-37B | 673.25 | 672.99 |
| DSL-47B | 727.24 | 727.88 |
| DSL-48B | 661.25 | 661.12 |
| DSL-58B | 739.26 | 738.95 |
| DSL-65B | 799.20 | 798.83 |
| DSL-67B | 675.27 | 675.07 |
| DSL-105B | 709.25 | 709.03 |
| DSL-107B | 723.27 | 722.93 |
| DSL-111B | 695.24 | 695.09 |

DSL Synthesis Method 6

2-Chlorotrityl resin 1 (300 mg, 0.3 mmol) was swelled in dry DCM (5 mL) for 30 mins. Solvent was removed with nitrogen and a solution of 2-(1-((((9H-fluoren-9-yl)methoxy)carbonyl)amino)cyclopentyl)acetic acid 17 (109 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 18. The resin was washed with DCM (3×5 mL) then DMF (3×5 mL) and treated with 20% piperidine in DMF for 5 minutes (3×5 mL), washed with DMF (4×5 mL). Solution of (2S,4S)-1-(((9H-fluoren-9-yl)methoxy)carbonyl)-4-((((9H-fluoren-9-yl)methoxy)carbonyl)amino)pyrrolidine-2-carboxylic acid, 19 (0.229 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 20. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 21. The resin was washed with DMF (4×5 mL) and DCM (3×5 mL).

Cleavage of Diboronated Sensor from Resin

Compound 21 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid (DSL-60A) which was used in the next step without purification.

Crude diboronated sensor acid DSL-60A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl 2-(1-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclopentyl)acetate DSL-60B in ~22% yield (14.7 mg). Calculated mass $(M+H)^+=673.2$, Observed mass $(M+H)^+=673.0$ Similar procedures were followed for the synthesis of DSL-61B to DSL-77B, and DSL-108B.

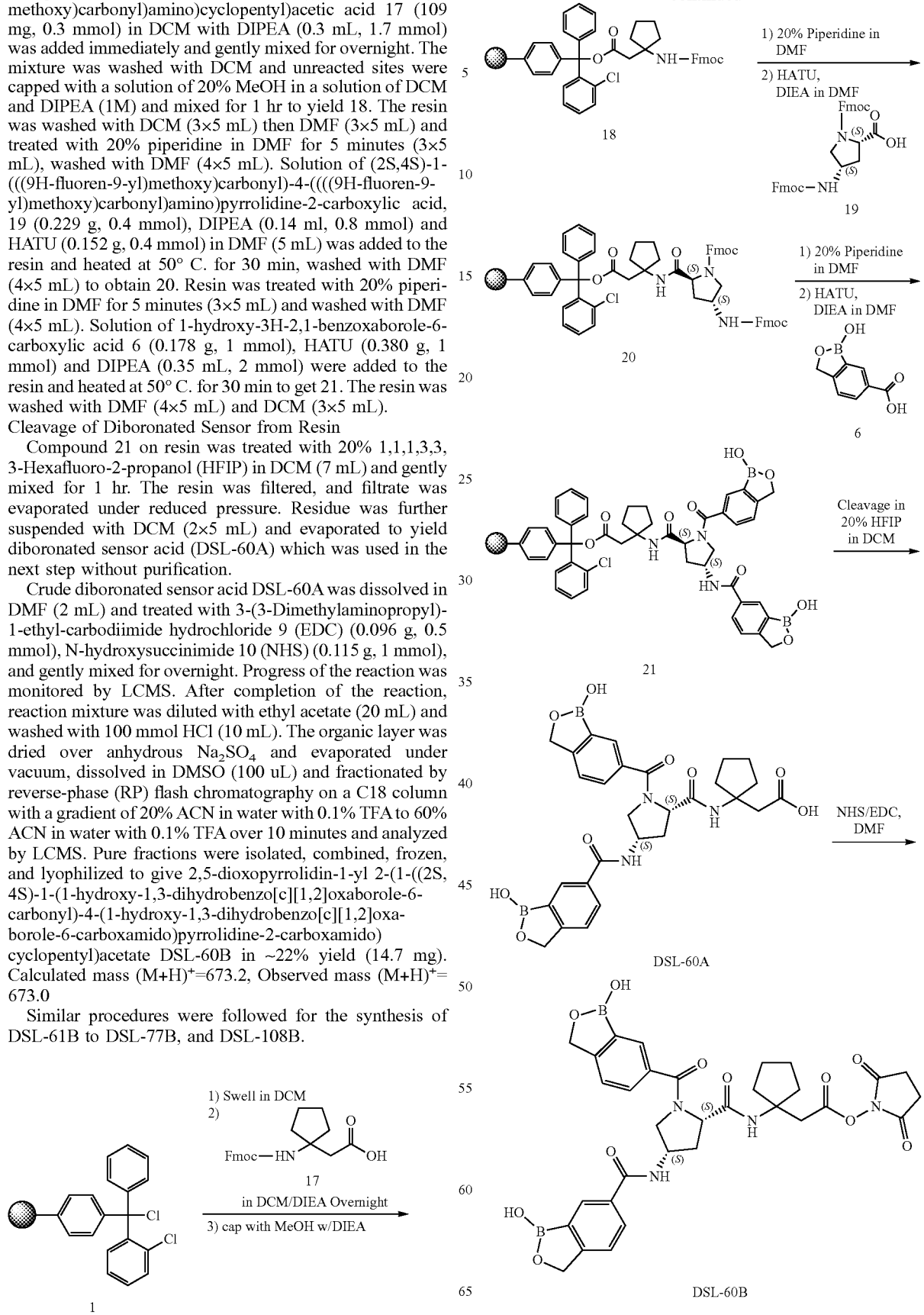

The MS data for DSL-60B is listed in Table V. The other examples listed in Table V below were synthesized under similar conditions.

TABLE V

| DSL-B Examples | Mass Calculated $[M + H]^{+1}$ | Mass Observed $[M + H]^{+1}$ |
|---|---|---|
| DSL-60B | 672.24 | |
| DSL-77B | 619.20 | 619.11 |
| DSL-108B | 655.19 | |

DSL Synthesis Method 7

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy) carbonyl)amino)propanoic acid 2 (94 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of $N^2$-(((9H-fluoren-9-yl) methoxy)carbonyl)-$N^6$-((allyloxy)carbonyl)-L-lysine 22 (0.181 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 23 followed by treatment with 20% piperidine in DMF for 5 minutes (3×5 mL) and washed with DMF (4×5 mL). Solution of (2S,4R)-1-(((9H-fluoren-9-yl)methoxy) carbonyl)-4-((((9H-fluoren-9-yl)methoxy)carbonyl)amino) pyrrolidine-2-carboxylic acid, 14 (0.229 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 24. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 25. The resin was washed with DMF (4×5 mL) and DCM (3×5 mL) and treated with Tetrakis(triphenylphosphine)palladium (20 mol %, 46 mg) and phenylsilane (493 ul, 4 mmol) in 6 mL DCM was agitated at room temperature for 1 h and washed with DCM (3×5 mL) and DMF (3×5 mL). Solution of octanoic acid 26 (63 ul, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 27.

Cleavage of Diboronated Sensor from Resin

Compound 27 on resin was treated with 20% 1,1,1,3,3, 3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-68A which was used in the next step without purification.

7b: NHS-Activation of Diboronated Sensor:

Crude diboronated sensor acid DSL-68A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl 3-((S)-2-((2R,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-octanamidohexanamido)propanoate DSL-68B in ~30% yield (26.1 mg). Calculated mass $(M+H)^+$=873.4, Observed mass $(M+H)^+$=873.2

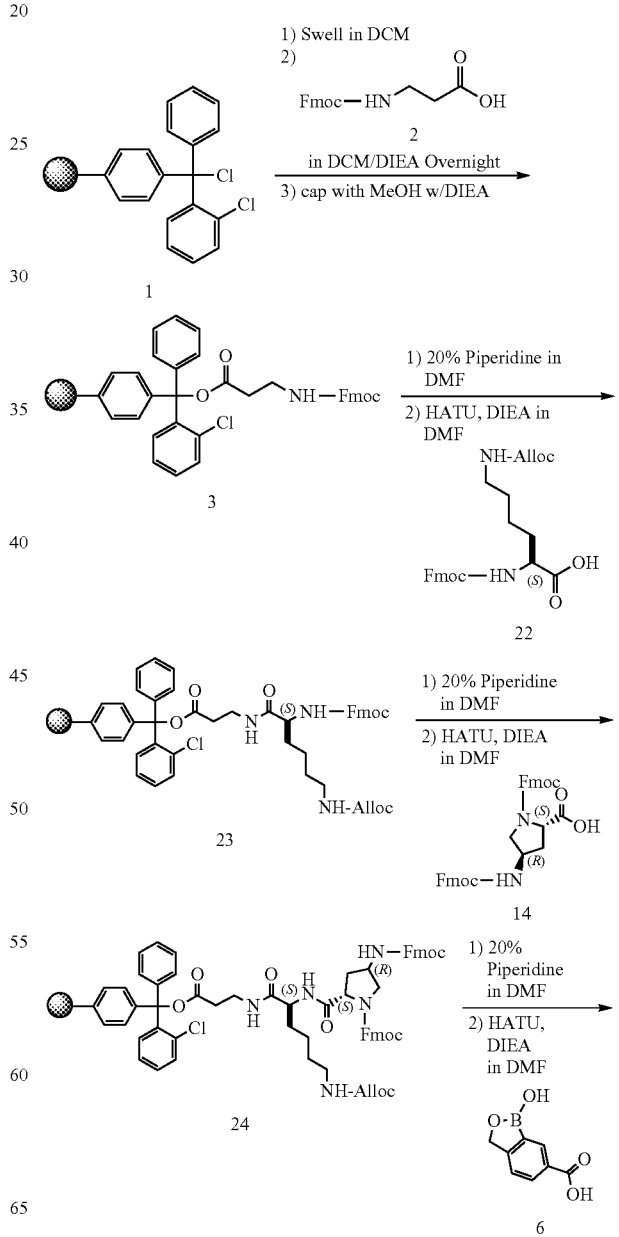

455

-continued

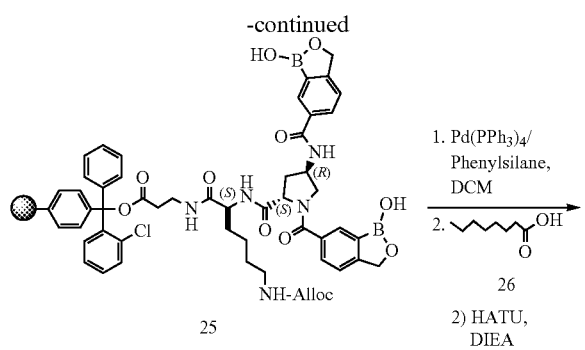

25

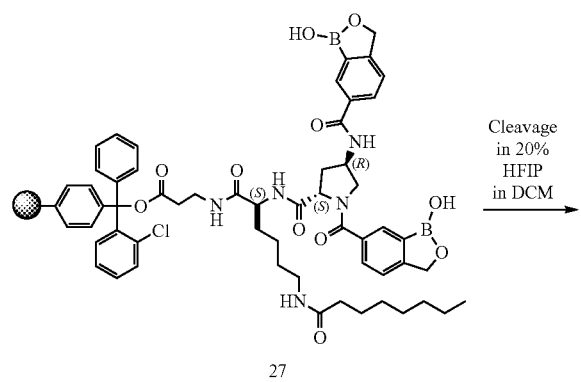

27

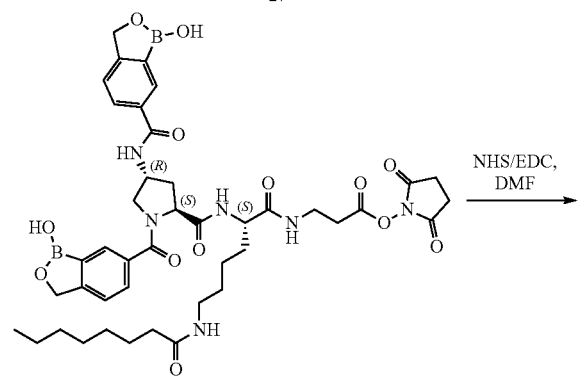

DSL-68A

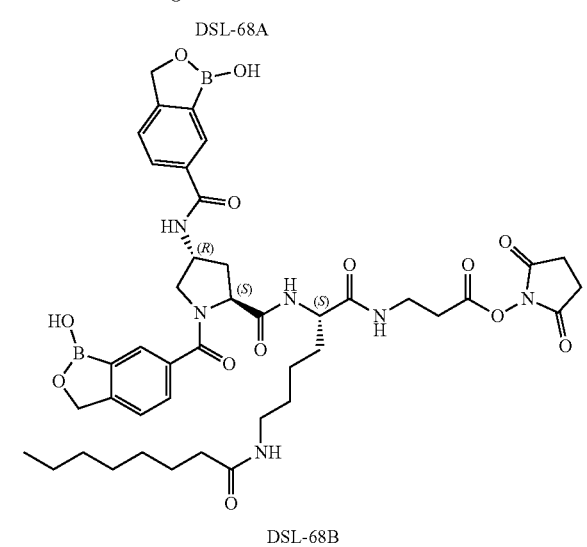

DSL-68B

456

DSL Synthesis Method 8

Synthesis of (R)-3,4-bis((((9H-fluoren-9-yl)methoxy)carbonyl)amino)butanoic acid In 100 mL round bottom flask (3R)-3-{[(tert-butoxy)carbonyl]amino}-4-{[(9H-fluoren-9-ylmethoxy)carbonyl]amino}butanoic acid (1 g, 2.27 mmol) was treated with 1:1 TFA:DCM (15 mL) and stirred at room temperature for 1 h. After completion of the reaction, solvent was removed under reduced pressure and further co-evaporated with DCM (15 mL×3). The oily product was dissolved in 5:1 10% sodium carbonate and THF (50 mL) followed by the addition of Fmoc-OSu (0.76 g, 2.27 mmol) in THF (10 mL) and stirred for 15 h. The reaction mixture was diluted with ethyl acetate (35 mL) and acidified with 1N HCl to pH ~3. The organic layer was separated and aqueous layer was extracted with ethyl acetate (2×15 mL) washed with brine, dried over anhydrous sodium sulphate and evaporated under reduced pressure to get (R)-3,4-bis((((9H-fluoren-9-yl)methoxy)carbonyl)amino)butanoic acid (1.2 g, 95%).

Synthesis of 2,5-dioxopyrrolidin-1-yl (R)-3-(3,4-bis(1-hydroxy-1,3-dihydrobenzo[c][1,2]oxaborole-6-carboxamido)butanamido)propanoate 2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy)carbonyl)amino)propanoic acid 2 (94 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of (R)-3,4-bis((((9H-fluoren-9-yl)methoxy)carbonyl)amino)butanoic acid 30 (0.224 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 31. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 32. The resin was washed with DMF (4×5 mL) and DCM (3×5 mL).

Cleavage of Diboronated Sensor from Resin

Compound 32 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-104A which was used in the next step without purification.

8b: NHS-Activation of Diboronated Sensor:

Crude diboronated sensor acid DSL-104A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DSL-104B 2,5-dioxopyrrolidin-1-yl (R)-3-(3,4-bis(1-hydroxy-1,3-dihydrobenzo[c][1,2]oxaborole-6-carboxamido)butanamido)propanoate ~22% yield (13 mg). Calculated mass $(M+H)^+$ =607.2, Observed mass $(M+H)^+$=607.1

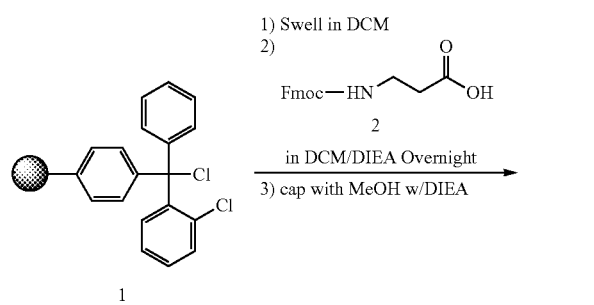

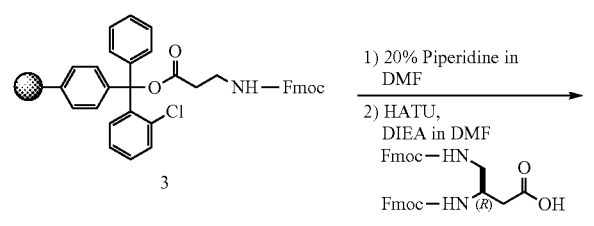

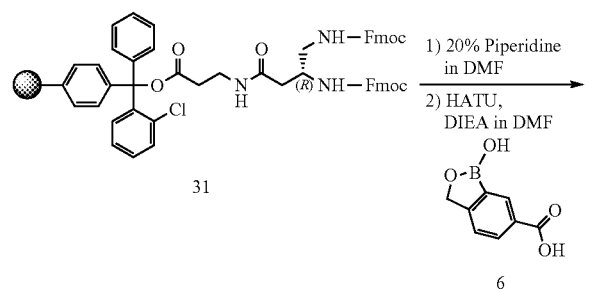

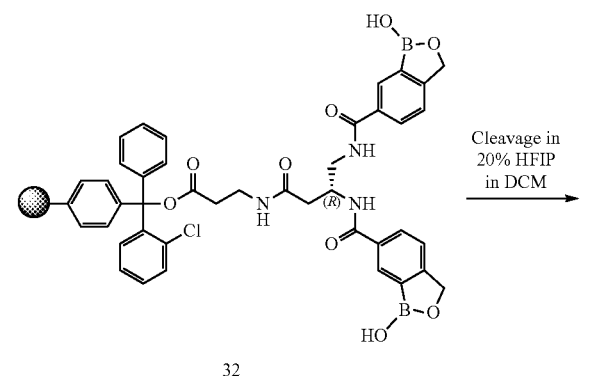

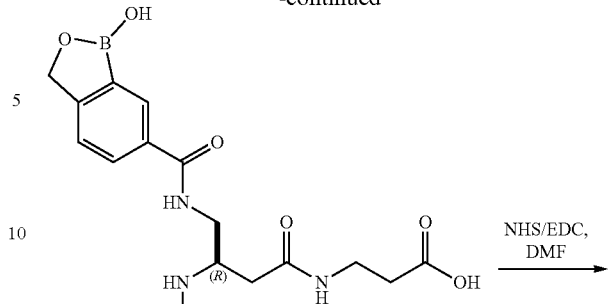

DSL-104A

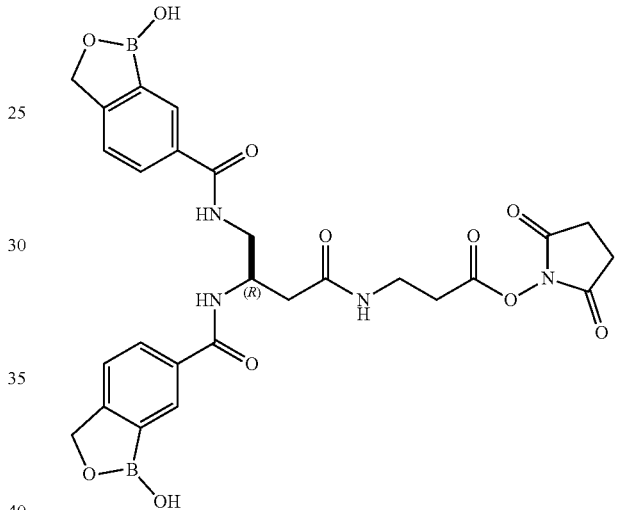

DSL-104B

DSL Synthesis Method 9

Synthesis of 2,5-dioxopyrrolidin-1-yl (R)-3-(4,5-bis(1-hydroxy-1,3-dihydrobenzo[c][1,2]oxaborole-6-carboxamido)pentanamido)propanoate 2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy)carbonyl)amino)propanoic acid 2 (94 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of (R)-4,5-bis((((9H-fluoren-9-yl)methoxy)carbonyl)amino)pentanoic acid 33 (0.224 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 34. Resin was treated with 20% piperidine in DMF for 5 minutes (3×5 mL) and washed with DMF (4×5 mL). Solution of 1-hydroxy-3H-2,1-benzoxaborole-6-carboxylic acid 6 (0.178 g, 1 mmol), HATU (0.380 g, 1 mmol) and DIPEA (0.35 mL, 2 mmol) were added to the resin and heated at 50° C. for 30 min to get 35. The resin was washed with DMF (4×5 mL) and DCM (3×5 mL).

Cleavage of Diboronated Sensor from Resin

Compound 35 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-106A which was used in the next step without purification.

9b: NHS-Activation of Diboronated Sensor:

Crude diboronated sensor acid DSL-106A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DSL-106B 2,5-dioxopyrrolidin-1-yl (R)-3-(4,5-bis(1-hydroxy-1,3-dihydrobenzo[c][1,2]oxaborole-6-carboxamido)pentanamido)propanoate ~30% yield (18.6 mg). Calculated mass $(M+H)^+= 621.2$, Observed mass $(M+H)^+=621.1$

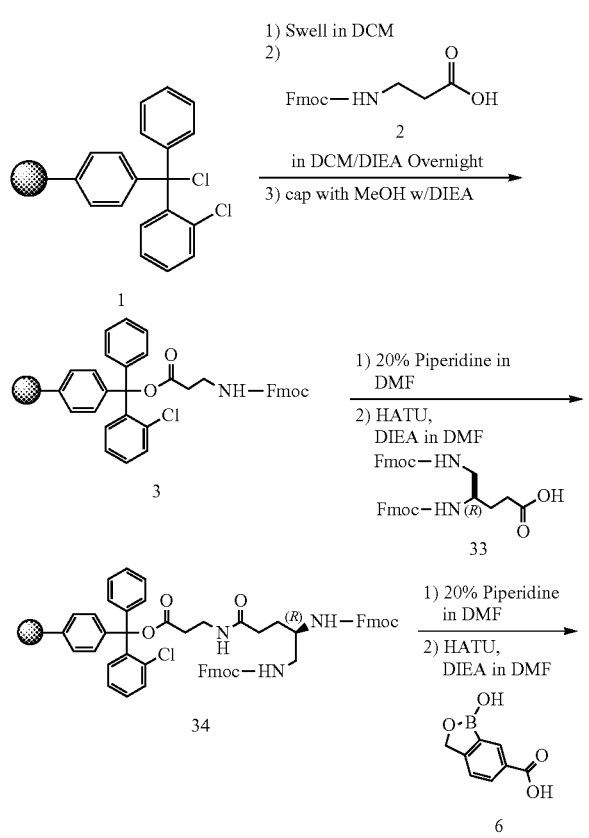

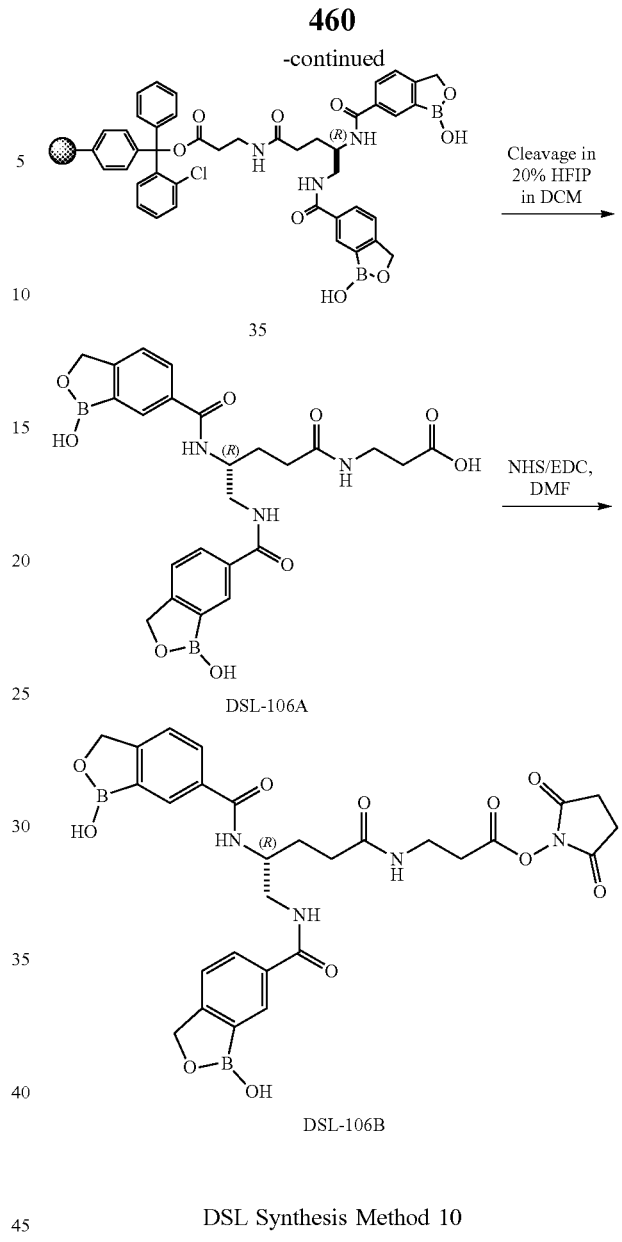

DSL Synthesis Method 10

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy)carbonyl) amino)propanoic acid 2 (0.93 mg, 0.3 mmol) in DCM with DIPEA (0.3 mL, 1.7 mmol)) was added immediately and gently mixed for overnight. The mixture was washed with DCM and unreacted sites were capped with a solution of 20% MeOH in a solution of DCM and DIEA (1M) and mixed for 1 hr to yield 3. The resin was washed with DCM (3×5 mL) then DMF (3×5 mL). The resin was treated 20% piperidine with DMF for 5 minutes (3×5 mL) and washed with DMF (4×5 mL). Solution of (2S,3S)-(Fmoc-amino)-3-azidobutyric acid 4 (0.146 g, 0.4 mmol), DIPEA (0.14 mL, 0.8 mmol) and HATU (0.152 g, 0.4 mmol) was added to the resin and heated at 50° C. for 30 min to give 5. Resin was washed with DMF (4×5 mL) and THF (3×5 mL) and treated with 5 mL solution of 0.2M $SnCl_2$ (189 mg), 0.8M thiophenol (440 ul) and 1M DIEA (870 ul) in THF and gently mix it for 1 hr on shaker. After 1 h, washed the resin with THF (3×5 mL) and DMF (3×5 mL) to give 36. Solution of 1-hydroxy-3H-2,1-benzoxaborole-6-carboxylic acid 6

(0.178 g, 1 mmol), HATU (0.380 g, 1 mmol) and DIPEA (0.35 ml, 2 mmol) was added to the resin (6a) and heated at 50° C. for 30 min to get 37.

Resin was washed with DMF (5×5 mL) and treated with 20% piperidine in DMF for 5 minutes (3×5 mL) and washed with DMF (4×5 mL) followed by coupling with 38 to give 39. The resin was washed with DMF (4×5 mL) and DCM (3×5 mL).

Cleavage of Diboronated Sensor from Resin

Compound 39 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-109A which was used in the next step without purification.

10b: NHS-Activation of Diboronated Sensor:

Diboronated sensor acid DSL-109A was dissolved in DMF (2 mL) and treated with 3-(3-Dimethylaminopropyl)-1-ethyl-carbodiimide hydrochloride 9 (EDC) (0.096 g, 0.5 mmol), N-hydroxysuccinimide 10 (NHS) (0.115 g, 1 mmol), and then was gently mixed overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and dried under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes gave the desired product as analyzed by LCMS. Pure fractions were isolated, combined, frozen, and lyophilized to give 2,5-dioxopyrrolidin-1-yl 3-((2S,3S)-2-(4-fluoro-1-hydroxy-1,3-dihydrobenzo[c][1,2]oxaborole-6-carboxamido)-3-(1-hydroxy-1,3-dihydrobenzo[c][1,2]oxaborole-6-carboxamido)butanamido)propanoate DSL-109B in 20% yield (12.5 mg). Calculated mass $(M+H)^+$=625.1, Observed mass $(M+H)^+$=625.1

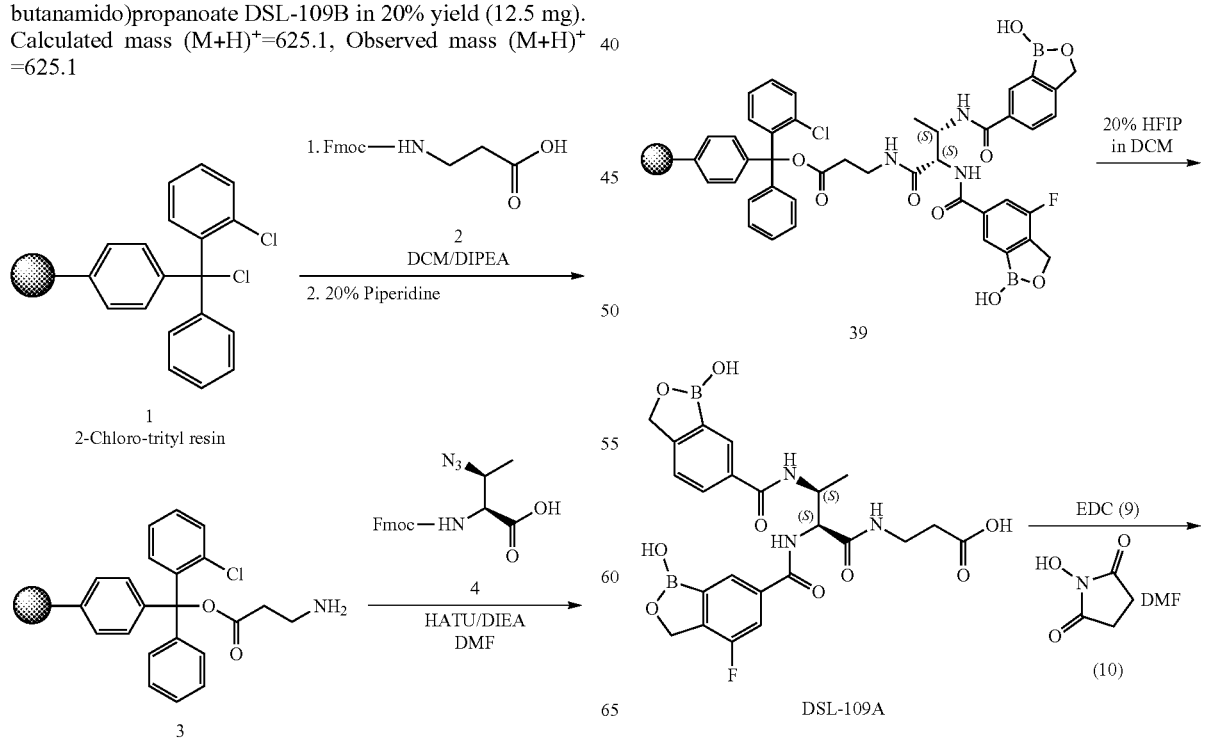

-continued

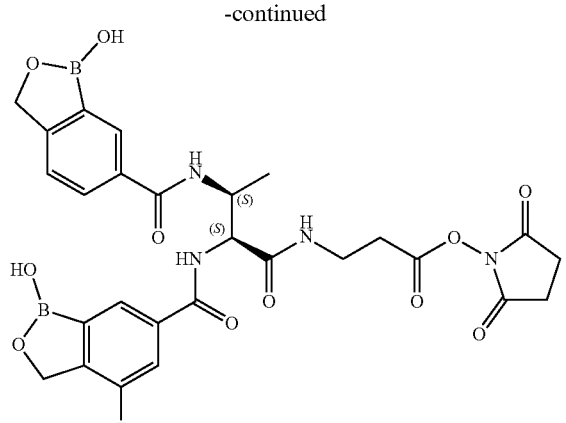

DSL-109B

The MS data for DSL-109B is listed in Table VI. The example listed in Table VI below was synthesized under similar conditions.

TABLE VI

| DSL-B Examples | Mass Calculated [M + H]⁺¹ | Mass Observed [M + H]⁺¹ |
|---|---|---|
| DSL-109B | 624.18 | |
| DSL-110B | 675.19 | 675.07 |

The chemical structure and IUPAC name of DSL-1A to DSL-112A are summarized in Table 1 below.

TABLE 1

| Compound # | FF | FL | F | Structure/IUPAC |
|---|---|---|---|---|
| DSL-1A | FF12A | FL38 | F2 | 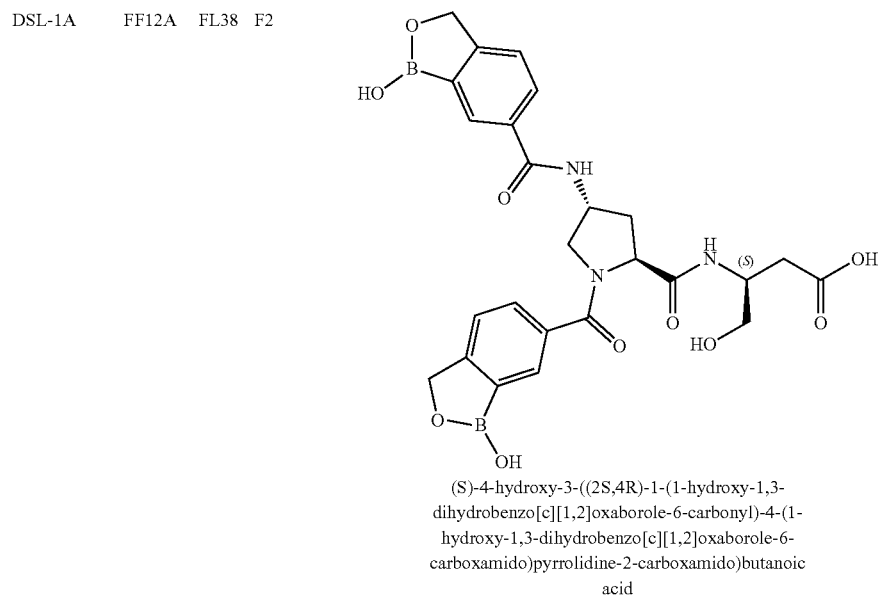 (S)-4-hydroxy-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)butanoic acid |
| DSL-2A | FF12A | FL5B | F2 | 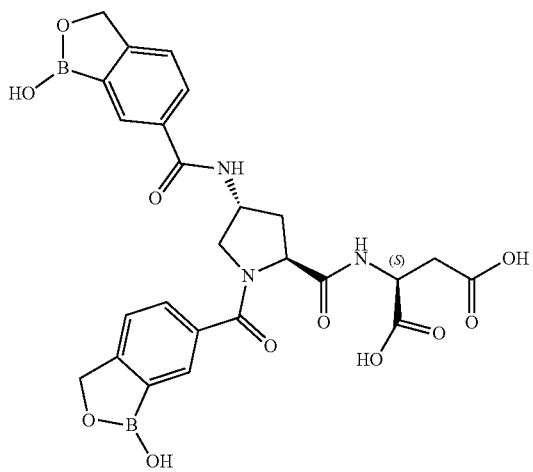 |

TABLE 1-continued

| Compound # | FF | FL | F | Structure/IUPAC |
|---|---|---|---|---|
| | | | | ((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-L-aspartic acid |
| DSL-3A | FF12A | FL22 | F2 | 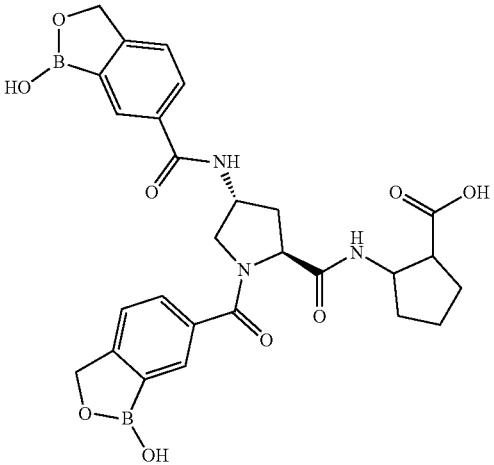 2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclopentane-1-carboxylic acid |
| DSL-4A | FF12A | FL20 | F2 | 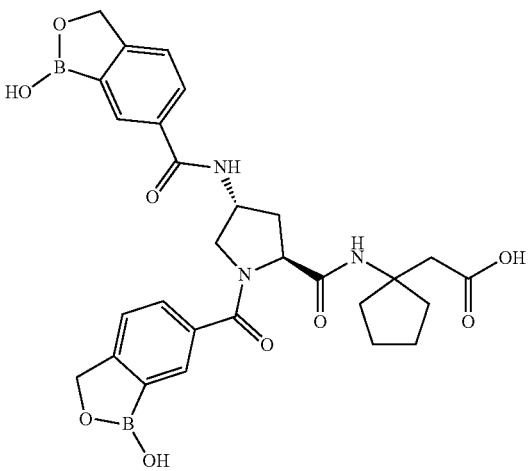 2-(1-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclopentyl)acetic acid |

TABLE 1-continued

| Compound # | FF | FL | F | Structure/IUPAC |
|---|---|---|---|---|
| DSL-5A | FF12A | FL24 | F2 | 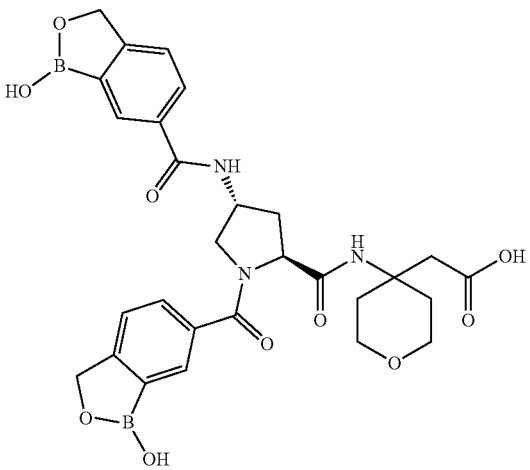 2-(4-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)tetrahydro-2H-pyran-4-yl)acetic acid |
| DSL-6A | FF12A | FL3 | F2 | 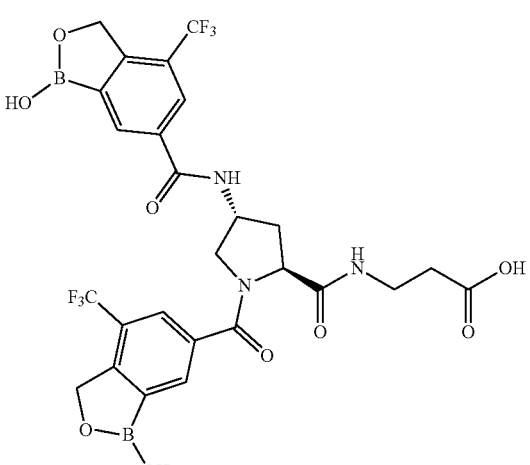 3-((2S,4R)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carboxamido)propanoic acid |

TABLE 1-continued

| Compound # | FF | FL | F | Structure/IUPAC |
|---|---|---|---|---|
| DSL-7A | FF12A | FL39 | F2 | 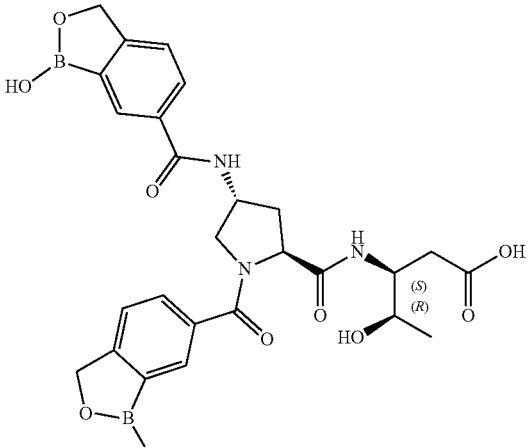 (3S,4R)-4-hydroxy-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)pentanoic acid |
| DSL-8A | FF12A | FL23 | F2 | 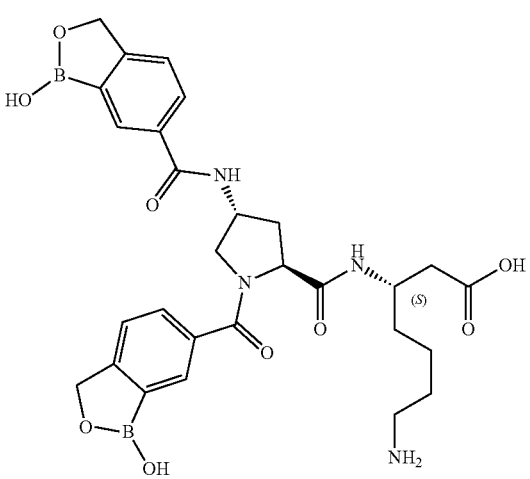 (S)-7-amino-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)heptanoic acid |
| DSL-9A | FF116A | FL21 | F2 | 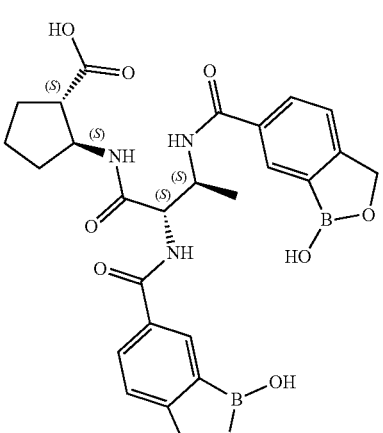 (1S,2S)-2-((2S,3S)-2,3-bis(1-hydroxy-1,3-dihydrobenzo[c][1,2]oxaborole-6- |

TABLE 1-continued

| Compound # | FF | FL | F | Structure/IUPAC |
|---|---|---|---|---|
| | | | | carboxamido)butanamido)cyclopentane-1-carboxylic acid |
| DSL-10A | FF116A | FL24 | F2 | 2-(4-((2S,3S)-2,3-bis(1-hydroxy-1,3-dihydrobenzo[c][1,2]oxaborole-6-carboxamido)butanamido)tetrahydro-2H-pyran-4-yl)acetic acid |
| DSL-11A | FF116A | FL23 | F2 | (S)-7-amino-3-((2S,3S)-2,3-bis(1-hydroxy-1,3-dihydrobenzo[c][1,2]oxaborole-6-carboxamido)butanamido)heptanoic acid |
| DSL-12A | FF116A | FL36 | F2 | (S)-6-amino-3-((2S,3S)-2,3-bis(1-hydroxy-1,3-dihydrobenzo[c][1,2]oxaborole-6-carboxamido)butanamido)-6-oxohexanoic acid |

TABLE 1-continued

| Compound # | FF | FL | F | Structure/IUPAC |
|---|---|---|---|---|
| DSL-13A | FF116A | FL20 | F2 | 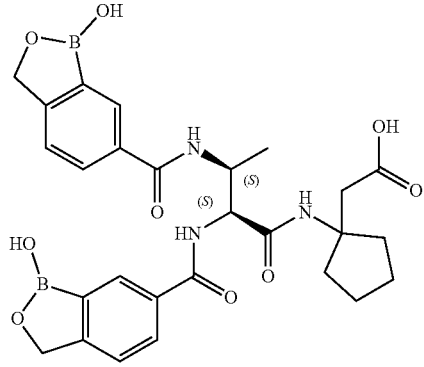<br>2-(1-((2S,3S)-2,3-bis(1-hydroxy-1,3-dihydrobenzo[c][1,2]oxaborole-6-carboxamido)butanamido)cyclopentyl)acetic acid |
| DSL-14A | FF116A | FL3 | F2 | 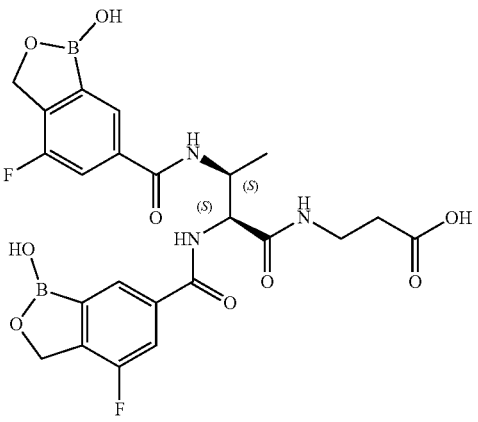<br>3-((2S,3S)-2,3-bis(4-fluoro-1-hydroxy-1,3-dihydrobenzo[c][1,2]oxaborole-6-carboxamido)butanamido)propanoic acid |
| DSL-15A | FF116A | FL38 | F2 | 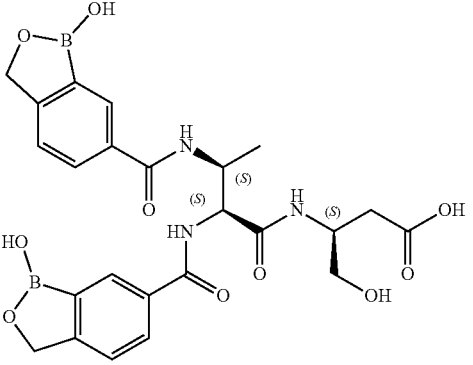<br>(S)-3-((2S,3S)-2,3-bis(1-hydroxy-1,3-dihydrobenzo[c][1,2]oxaborole-6-carboxamido)butanamido)-4-hydroxybutanoic acid |

| Compound # | FF | FL | F | Structure/IUPAC |
|---|---|---|---|---|
| DSL-16A | FF116A | FL5B | F2 | 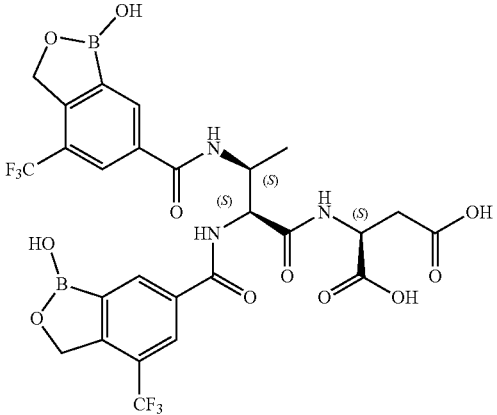<br>((2S,3S)-2-(1-hydroxy-4-(trifluoromethyl)-1,3-dihydrobenzo[c][1,2]oxaborole-6-carboxamido)-3-(1-hydroxy-4-(trifluoromethyl)-2,3-dihydro-1H-benzo[b]borole-6-carboxamido)butanoyl)-L-aspartic acid |
| DSL-17A | FF116A | FL39 | F2 | 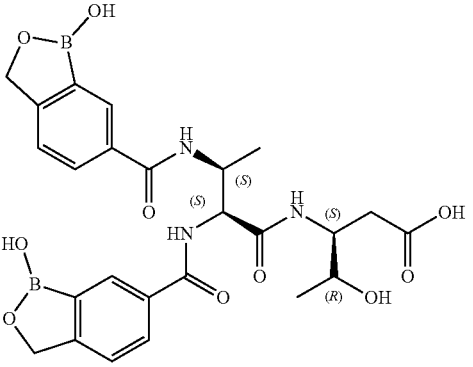<br>(3S,4R)-3-((2S,3S)-2,3-bis(1-hydroxy-1,3-dihydrobenzo[c][1,2]oxaborole-6-carboxamido)butanamido)-4-hydroxypentanoic acid |
| DSL-18A | FF116A | FL5B | F2 | 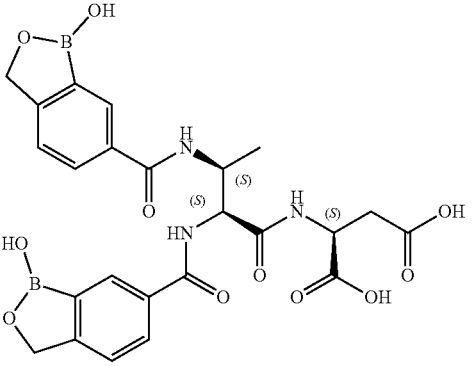<br>((2S,3S)-2,3-bis(1-hydroxy-1,3-dihydrobenzo[c][1,2]oxaborole-6-carboxamido)butanoyl)-L-aspartic acid |

TABLE 1-continued

| Compound # | FF | FL | F | Structure/IUPAC |
|---|---|---|---|---|
| DSL-19A | FF12A | FL3 | F2 | 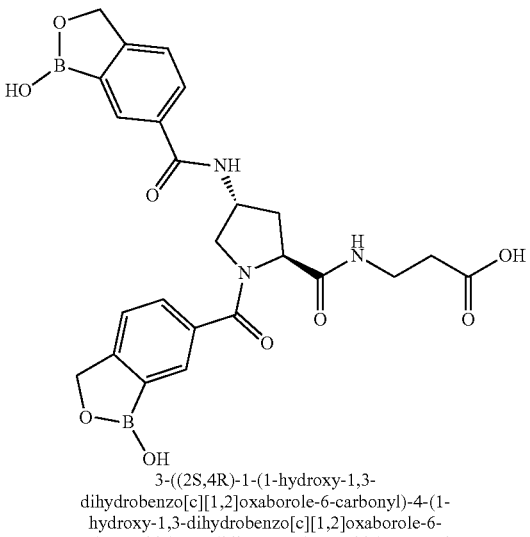 3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |
| DSL-20A | FF116A | FL35 | F2 | 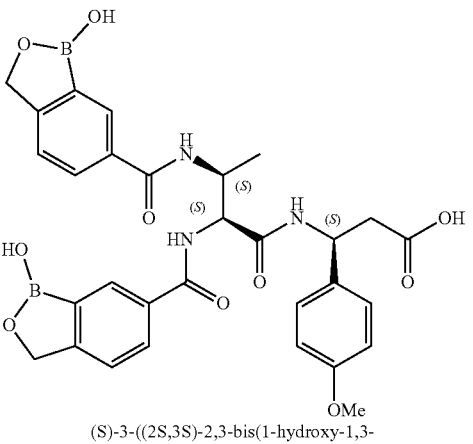 (S)-3-((2S,3S)-2,3-bis(1-hydroxy-1,3-dihydrobenzo[c][1,2]oxaborole-6-carboxamido)butanamido)-3-(4-methoxyphenyl)propanoic acid |
| DSL-21A | FF12A | FL5B | F2 | 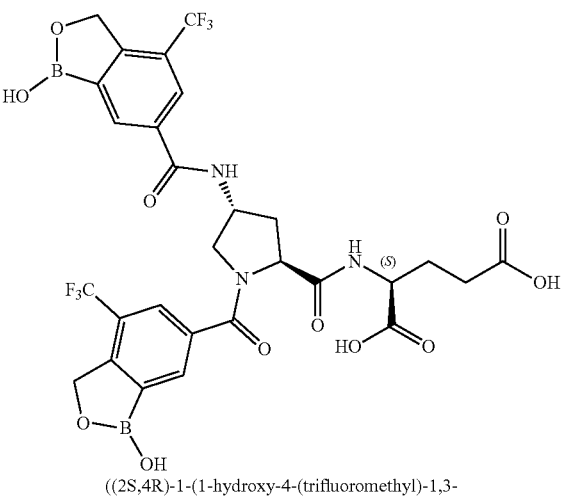 ((2S,4R)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6- |

TABLE 1-continued

| Compound # | FF | FL | F | Structure/IUPAC |
|---|---|---|---|---|
| | | | | carboxamido)pyrrolidine-2-carbonyl)-L-glutamic acid |
| DSL-22A | FF12A | FL3 | F2 | 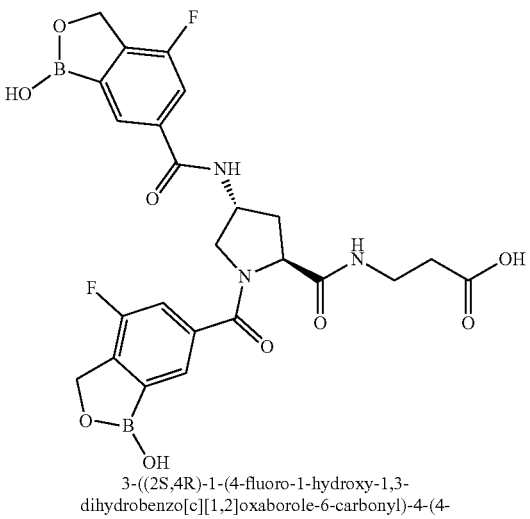 3-((2S,4R)-1-(4-fluoro-1-hydroxy-1,3-dihydrobenzo[c][1,2]oxaborole-6-carbonyl)-4-(4-fluoro-1-hydroxy-1,3-dihydrobenzo[c][1,2]oxaborole-6-carboxamido)pyrrolidine-2-carboxamido)propanoic acid |
| DSL-23A | FF116A | FL28 | F2 | 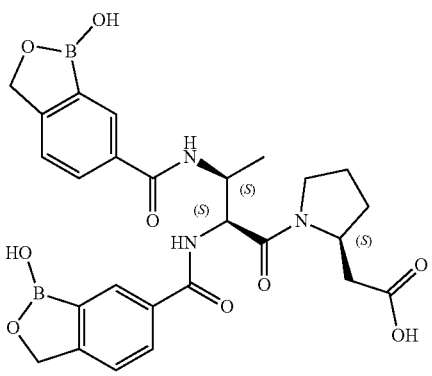 2-((S)-1-((2S,3S)-2,3-bis(1-hydroxy-1,3-dihydrobenzo[c][1,2]oxaborole-6-carboxamido)butanoyl)pyrrolidin-2-yl)acetic acid |
| DSL-24A | FF116A | FL41 | F2 | 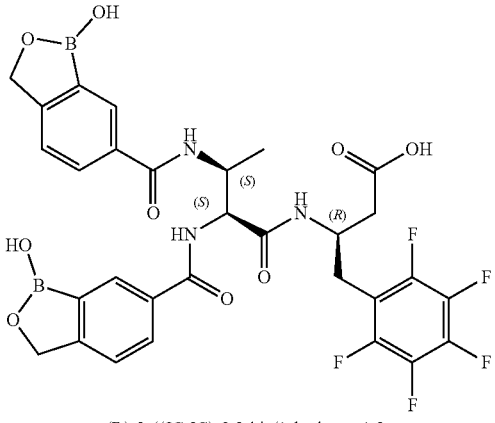 (R)-3-((2S,3S)-2,3-bis(1-hydroxy-1,3-dihydrobenzo[c][1,2]oxaborole-6-carboxamido)butanamido)-4-(perfluorophenyl)butanoic acid |

TABLE 1-continued

| Compound # | FF | FL | F | Structure/IUPAC |
|---|---|---|---|---|
| DSL-25A | FF116A | FL42 | F2 | 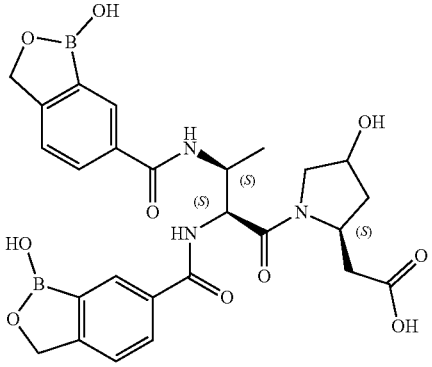 2-((2S)-1-((2S,3S)-2,3-bis(1-hydroxy-1,3-dihydrobenzo[c][1,2]oxaborole-6-carboxamido)butanoyl)-4-hydroxypyrrolidin-2-yl)acetic acid |
| DSL-26A | FF12A | FL42 | F2 | 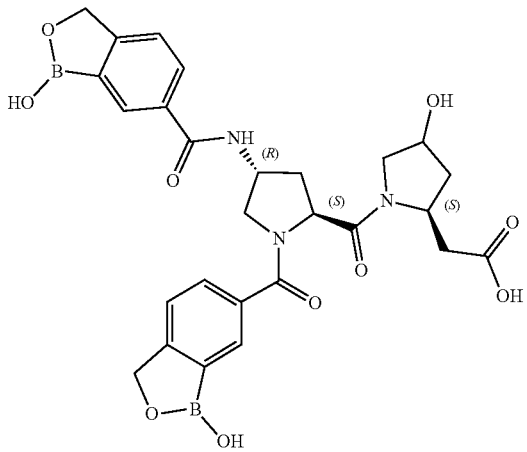 2-((2S)-4-hydroxy-1-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)pyrrolidin-2-yl)acetic acid |
| DSL-27A | FF116A | FL34 | F2 | 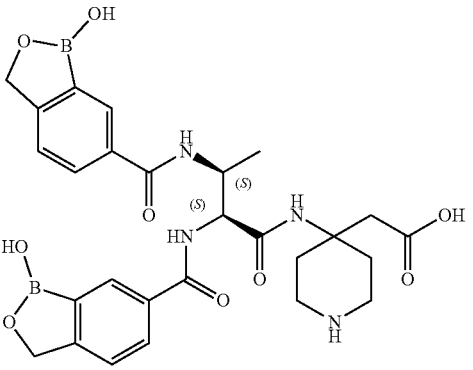 2-(4-((2S,3S)-2,3-bis(1-hydroxy-1,3-dihydrobenzo[c][1,2]oxaborole-6-carboxamido)butanamido)piperidin-4-yl)acetic acid |

TABLE 1-continued

| Compound # | FF | FL | F | Structure/IUPAC |
|---|---|---|---|---|
| DSL-28A | FF12A | FL34 | F2 | 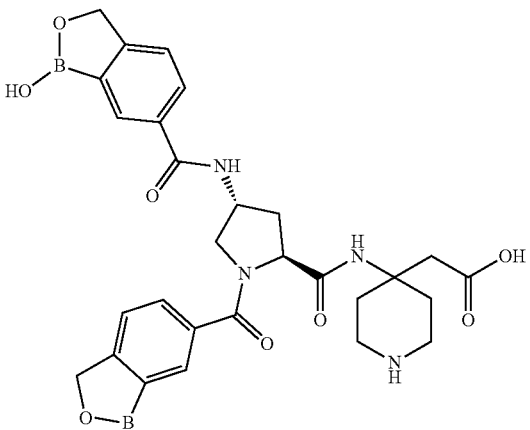 2-(4-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)piperidin-4-yl)acetic acid |
| DSL-29A | FF116A | FL27 | F2 | 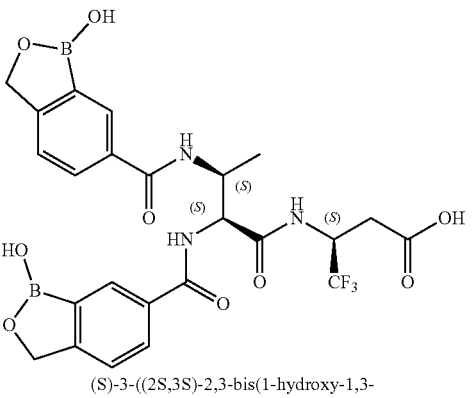 (S)-3-((2S,3S)-2,3-bis(1-hydroxy-1,3-dihydrobenzo[c][1,2]oxaborole-6-carboxamido)butanamido)-4,4,4-trifluorobutanoic acid |
| DSL-30A | FF12A | FL27 | F2 | 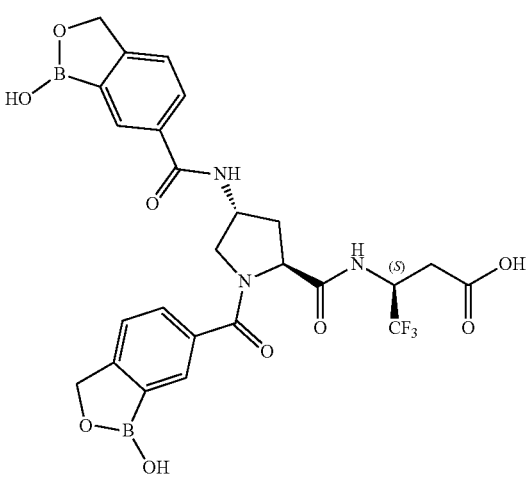 (S)-4,4,4-trifluoro-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)butanoic acid |

TABLE 1-continued

| Compound # | FF | FL | F | Structure/IUPAC |
|---|---|---|---|---|
| DSL-31A | FF116A | FL32 | F2 | 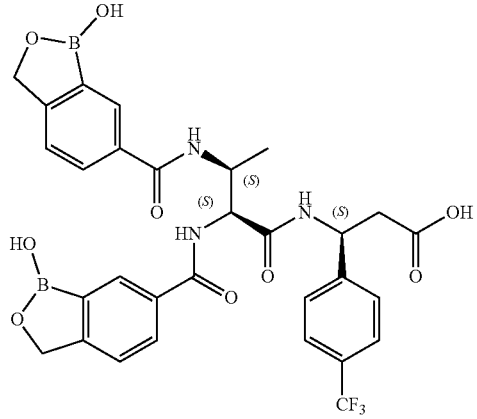 (S)-3-((2S,3S)-2,3-bis(1-hydroxy-1,3-dihydrobenzo[c][1,2]oxaborole-6-carboxamido)butanamido)-3-(4-(trifluoromethyl)phenyl)propanoic acid |
| DSL-32A | FF12A | FL5B | F2 | 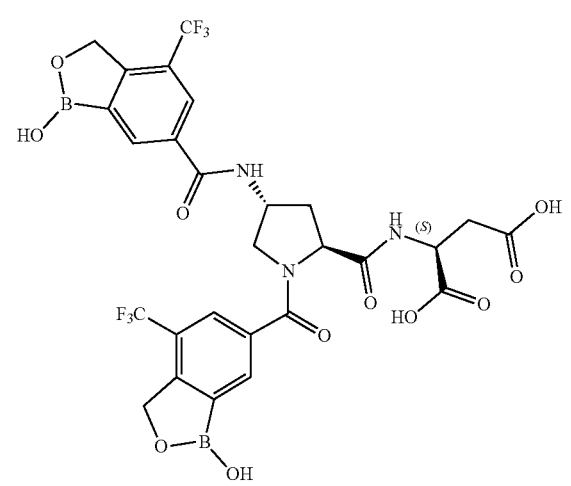 ((2S,4R)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carbonyl)-L-aspartic acid |
| DSL-33A | FF12A | FL32 | F2 | 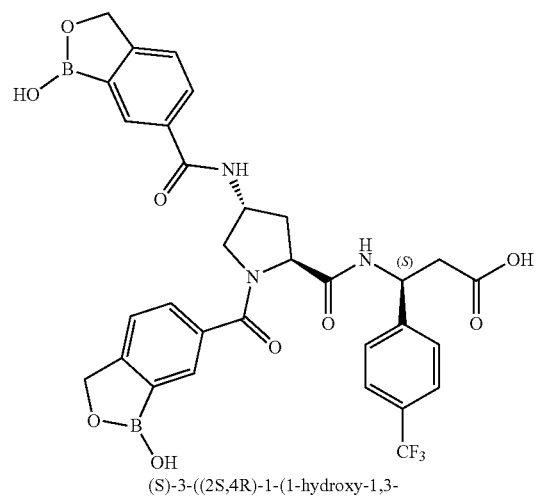 (S)-3-((2S,4R)-1-(1-hydroxy-1,3-dihydrobenzo[c][1,2]oxaborole-6-carbonyl)-4-(1- |

TABLE 1-continued

| Compound # | FF | FL | F | Structure/IUPAC |
|---|---|---|---|---|
| | | | | hydroxy-1,3-dihydrobenzo[c][1,2]oxaborole-6-carboxamido)pyrrolidine-2-carboxamido)-3-(4-(trifluoromethyl)phenyl)propanoic acid |
| DSL-34A | FF12A | FL29 | F2 | 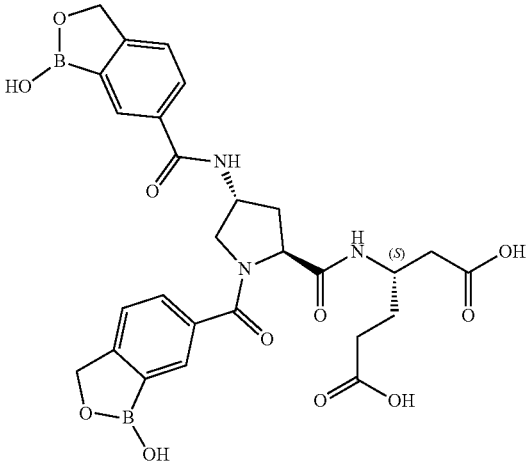 (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanedioic acid |
| DSL-35A | FF116A | FL29 | F2 | 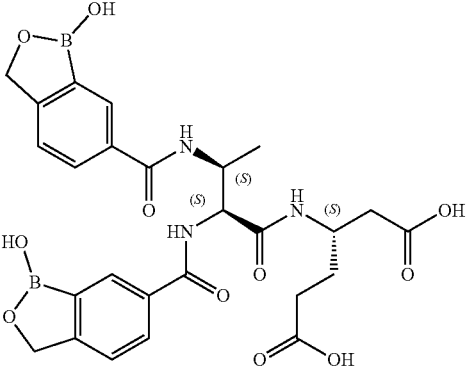 (S)-3-((2S,3S)-2,3-bis(1-hydroxy-1,3-dihydrobenzo[c][1,2]oxaborole-6-carboxamido)butanamido)hexanedioic acid |
| DSL-36A | FF116A | FL37 | F2 | 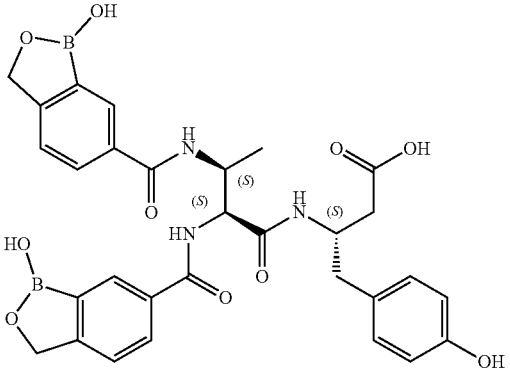 (S)-3-((2S,3S)-2,3-bis(1-hydroxy-1,3-dihydrobenzo[c][1,2]oxaborole-6-carboxamido)butanamido)-4-(4-hydroxyphenyl)butanoic acid |

TABLE 1-continued

| Compound # | FF | FL | F | Structure/IUPAC |
|---|---|---|---|---|
| DSL-37A | FF12A | FL25 | F2 | 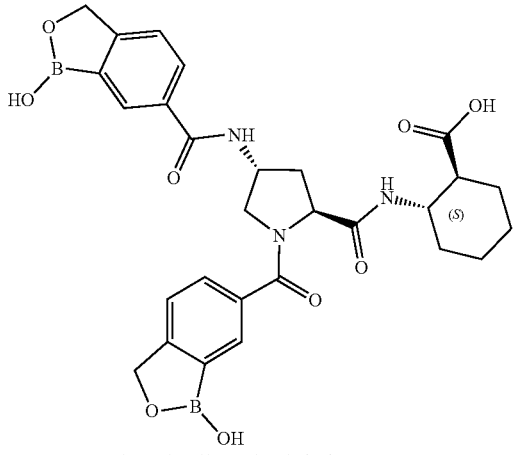<br>(1S,2S)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclohexane-1-carboxylic acid |
| DSL-38A | FF116A | FL25 | F2 | 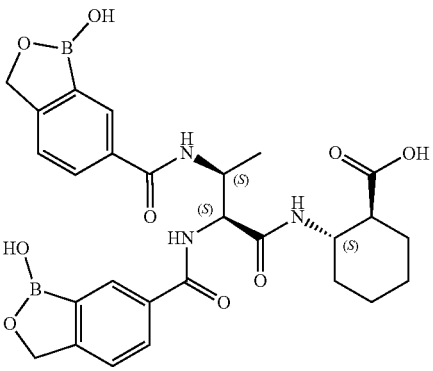<br>(1S,2S)-2-((2S,3S)-2,3-bis(1-hydroxy-1,3-dihydrobenzo[c][1,2]oxaborole-6-carboxamido)butanamido)cyclohexane-1-carboxylic acid |
| DSL-39A | FF12A | FL26 | F2 | 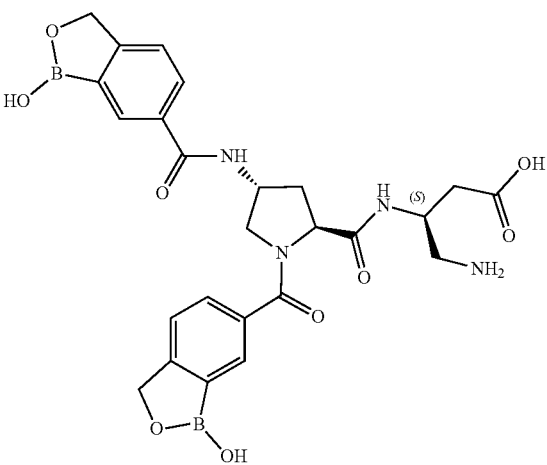<br>(S)-4-amino-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)butanoic acid |

TABLE 1-continued

| Compound # | FF | FL | F | Structure/IUPAC |
|---|---|---|---|---|
| DSL-40A | FF12A | FL31 | F2 | 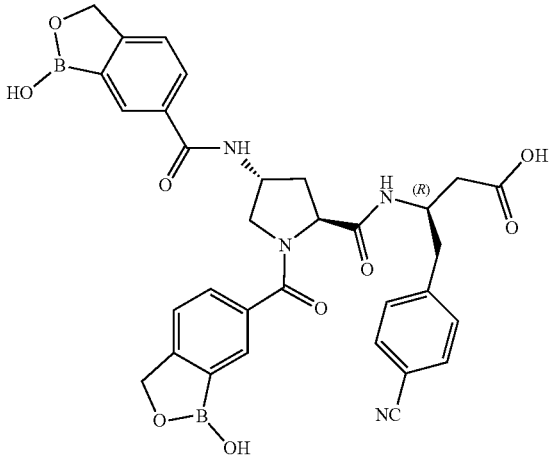 (R)-4-(4-cyanophenyl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)butanoic acid |
| DSL-41A | FF116A | FL40 | F2 | 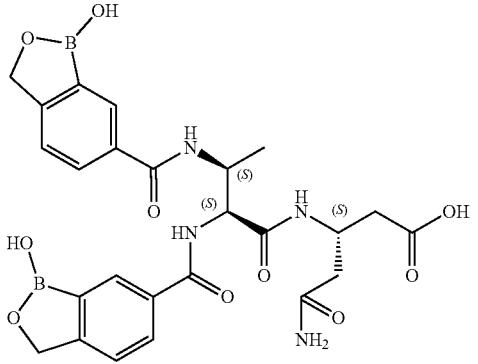 (S)-5-amino-3-((2S,3S)-2,3-bis(1-hydroxy-1,3-dihydrobenzo[c][1,2]oxaborole-6-carboxamido)butanamido)-5-oxopentanoic acid |
| DSL-42A | FF12A | FL37 | F2 | 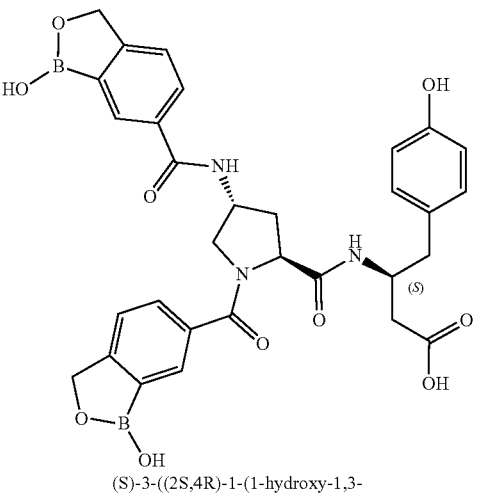 (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(4-hydroxyphenyl)butanoic acid |

TABLE 1-continued

| Compound # | FF | FL | F | Structure/IUPAC |
|---|---|---|---|---|
| DSL-43A | FF12A | FL40 | F2 | 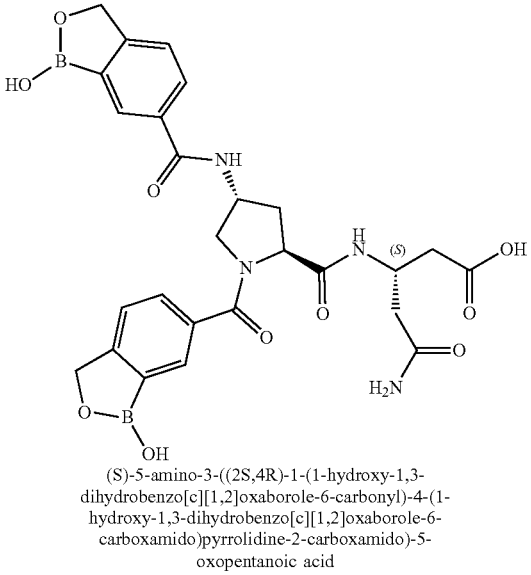<br>(S)-5-amino-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-5-oxopentanoic acid |
| DSL-44A | FF12A | FL62 | F2 | 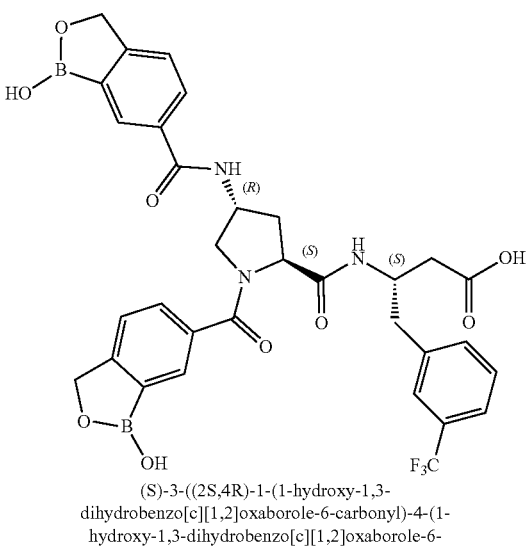<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(3-(trifluoromethyl)phenyl)butanoic acid |
| DSL-45A | FF12A | FL63 | F2 | 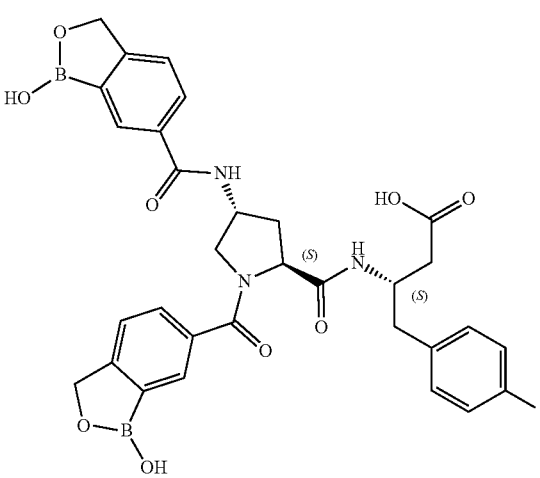 |

TABLE 1-continued

| Compound # | FF | FL | F | Structure/IUPAC |
|---|---|---|---|---|
| | | | | (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(4-iodophenyl)butanoic acid |
| DSL-46A | FF12A | FL56 | F2 | 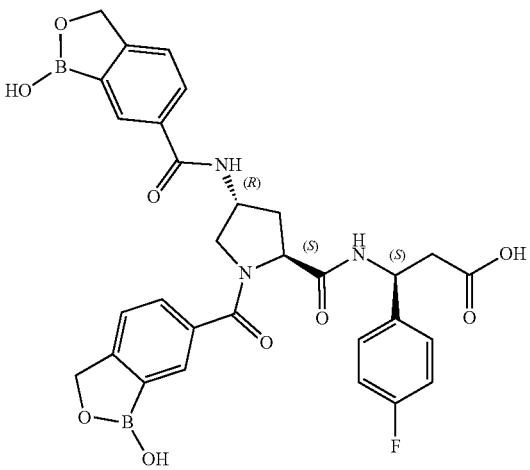<br>(S)-3-(4-fluorophenyl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |
| DSL-47A | FF12A | FL60 | F2 | 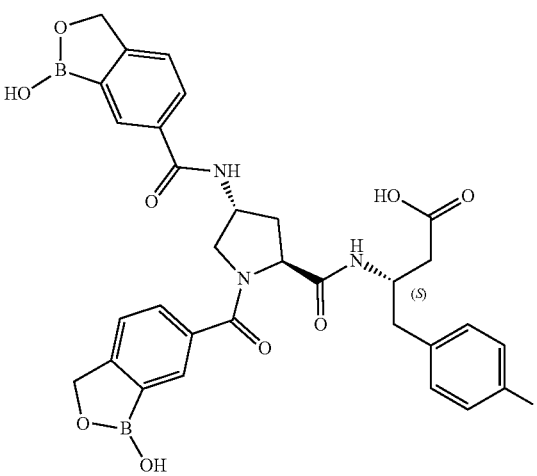<br>(S)-4-(4-fluorophenyl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)butanoic acid |

TABLE 1-continued

| Compound # | FF | FL | F | Structure/IUPAC |
|---|---|---|---|---|
| DSL-48A | FF12A | FL64 | F2 | 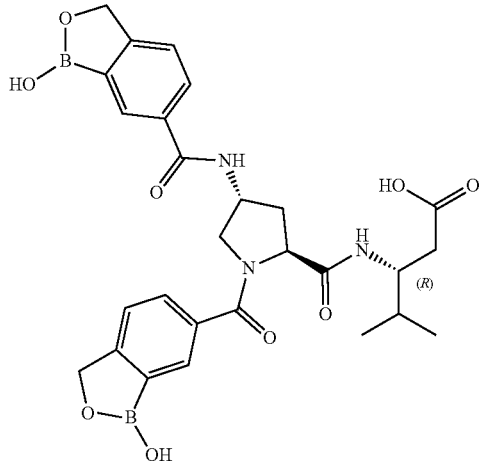<br>(R)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-methylpentanoic acid |
| DSL-49A | FF12A | FL32 | F2 | 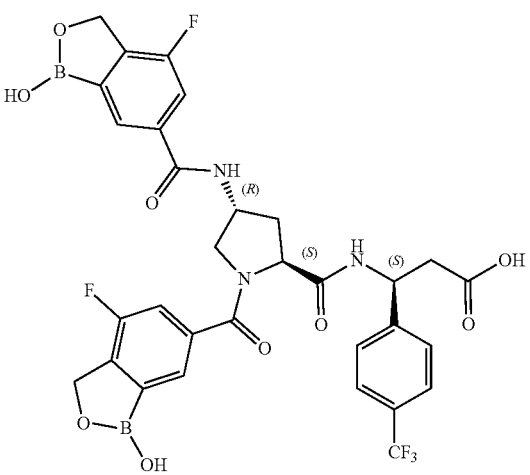<br>(S)-3-((2S,4R)-1-(4-fluoro-1-hydroxy-1,3-dihydrobenzo[c][1,2]oxaborole-6-carbonyl)-4-(4-fluoro-1-hydroxy-1,3-dihydrobenzo[c][1,2]oxaborole-6-carboxamido)pyrrolidine-2-carboxamido)-3-(4-(trifluoromethyl)phenyl)propanoic acid |

TABLE 1-continued

| Compound # | FF | FL | F | Structure/IUPAC |
|---|---|---|---|---|
| DSL-50A | FF12A | FL67 | F2 | 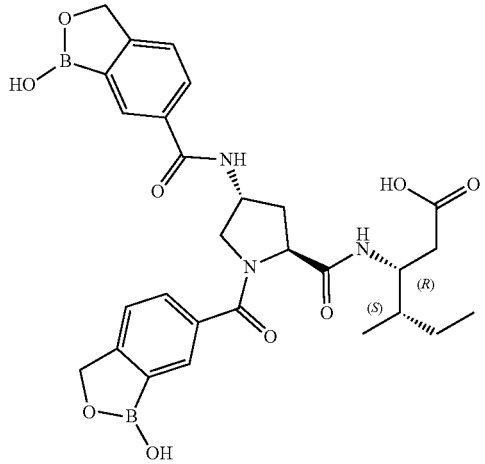<br>(3R)-3 (3R,4S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-methylhexanoic acid |
| DSL-51A | FF116A | FL5B | F2 | 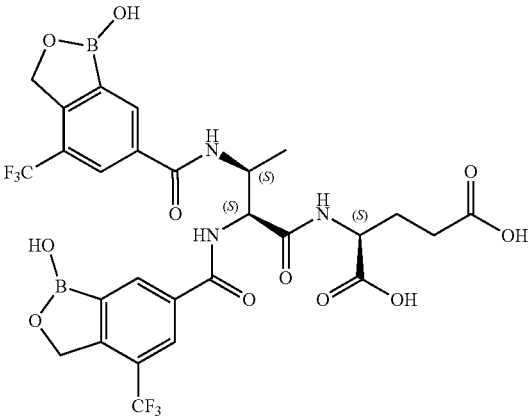<br>((2S,3S)-2,3-bis(1-hydroxy-4-(trifluoromethyl)-1,3-dihydrobenzo[c][1,2]oxaborole-6-carboxamido)butanoyl)-L-glutamic acid |
| DSL-52A | FF116A | FL26 | F2 | 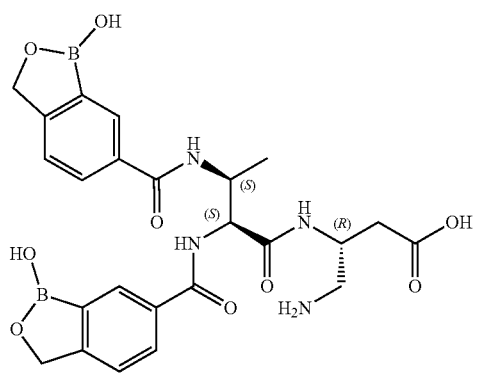<br>(R)-4-amino-3-((2S,3S)-2,3-bis(1-hydroxy-1,3-dihydrobenzo[c][1,2]oxaborole-6-carboxamido)butanamido)butanoic acid |

TABLE 1-continued

| Compound # | FF | FL | F | Structure/IUPAC |
|---|---|---|---|---|
| DSL-53A | FF12A | FL35 | F2 | 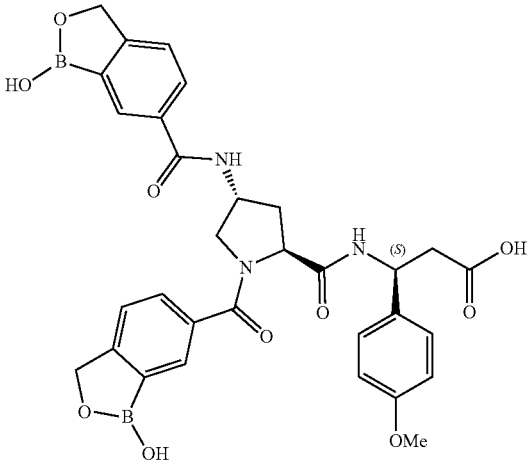 (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(4-methoxyphenyl)propanoic acid |
| DSL-54A | FF116A | FL40 | F2 | 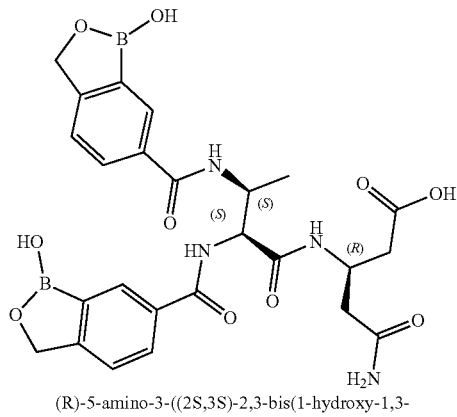 (R)-5-amino-3-((2S,3S)-2,3-bis(1-hydroxy-1,3-dihydrobenzo[c][1,2]oxaborole-6-carboxamido)butanamido)-5-oxopentanoic acid |
| DSL-55A | FF12A | FL30 | F2 | 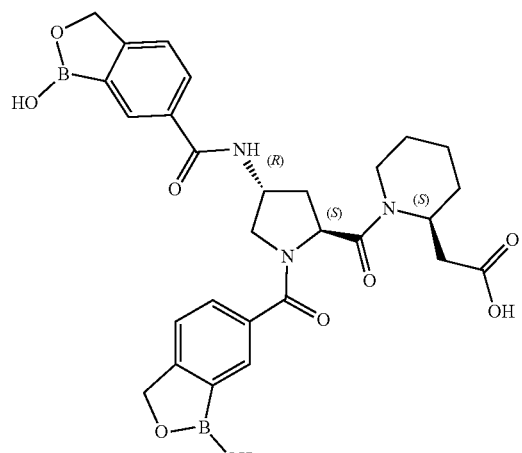 2-((S)-1-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)piperidin-2-yl)acetic acid |

TABLE 1-continued

| Compound # | FF | FL | F | Structure/IUPAC |
|---|---|---|---|---|
| DSL-56A | FF12A | FL5B | F2 | 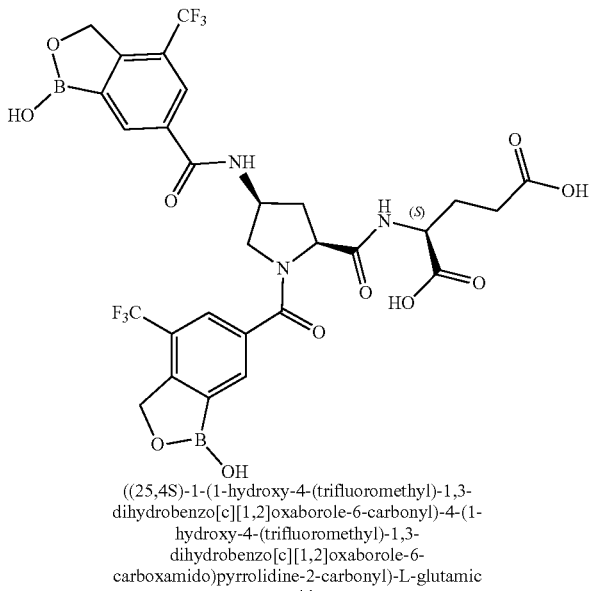<br>((2S,4S)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carbonyl)-L-glutamic acid |
| DSL-57A | FF116A | FL33 | F2 | 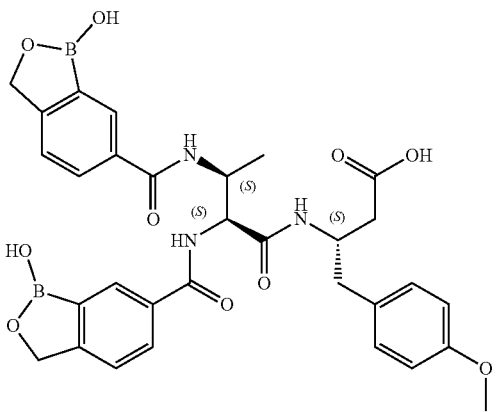<br>(S)-3-((2S,3S)-2,3-bis(1-hydroxy-1,3-dihydrobenzo[c][1,2]oxaborole-6-carboxamido)butanamido)-4-(4-methoxyphenyl)butanoic acid |
| DSL-58A | FF12A | FL33 | F2 | 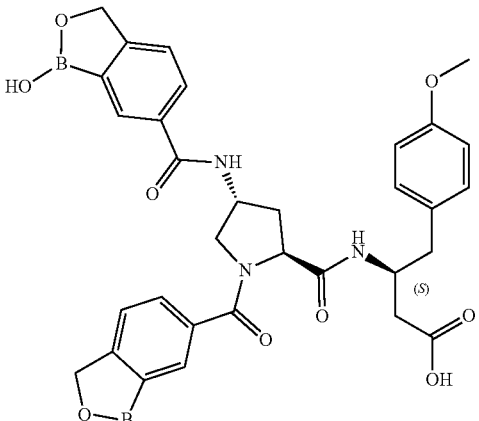<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6- |

TABLE 1-continued

| Compound # | FF | FL | F | Structure/IUPAC |
|---|---|---|---|---|
| | | | | carboxamido)pyrrolidine-2-carboxamido)-4-(4-methoxyphenyl)butanoic acid |
| DSL-59A | FF12A | FL36 | F2 | 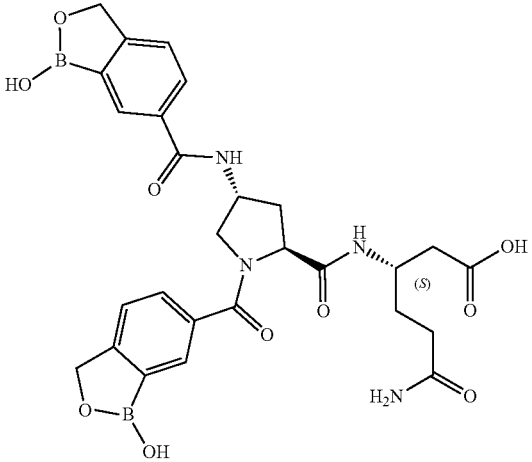<br>(S)-6-amino-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-oxohexanoic acid |
| DSL-60A | FF12B | FL20 | F2 | 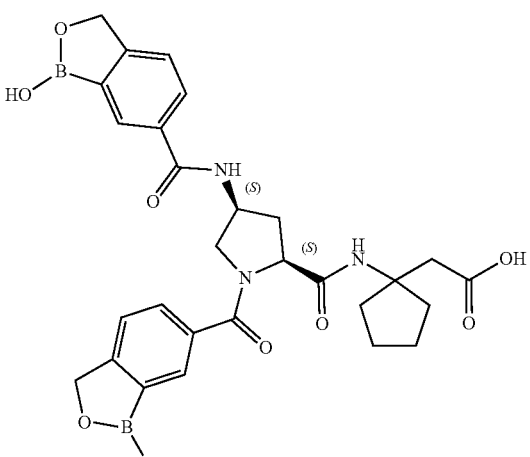<br>2-(1-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclopentyl)acetic acid |

TABLE 1-continued

| Compound # | FF | FL | F | Structure/IUPAC |
|---|---|---|---|---|
| DSL-61A | FF12B | FL32 | F2 | 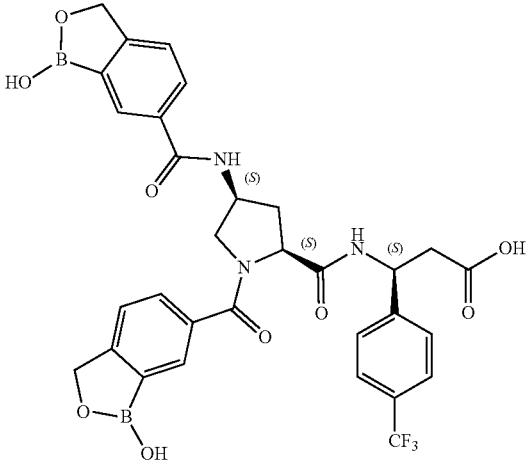<br>(S)-3-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(4-(trifluoromethyl)phenyl)propanoic acid |
| DSL-62A | FF12B | FL5B | F2 | 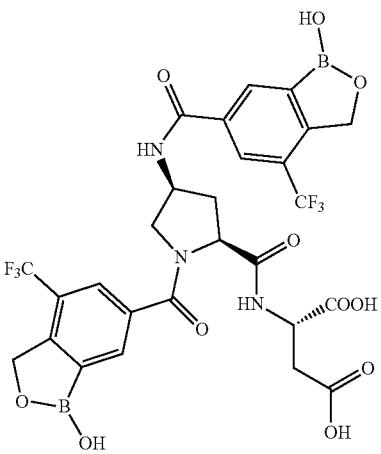 [SMILES: O=C(O)C[C@H](NC(=O)[C@@H]1C[C@H](NC(=O)c2cc3c(c(C(F)(F)F)c2)COB3O)CN1C(=O)c1cc2c(c(C(F)(F)F)c1)COB2O)C(=O)O]<br>((2S,4S)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carbonyl)-L-aspartic acid |
| DSL-63A | FF116A | FL30 | F2 | 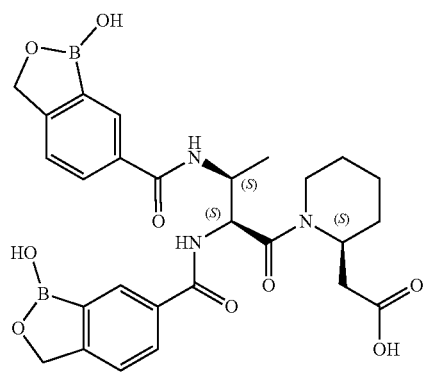<br>2-((S)-1-((2S,3S)-2,3-bis(1-hydroxy-1,3-dihydrobenzo[c][1,2]oxaborole-6-carboxamido)butanoyl)piperidin-2-yl)acetic acid |

| Compound # | FF | FL | F | Structure/IUPAC |
|---|---|---|---|---|
| DSL-64A | FF12A | FL28 | F2 | 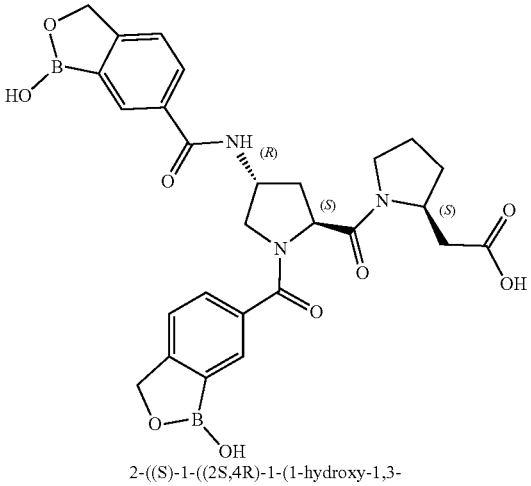<br>2-((S)-1-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)pyrrolidin-2-yl)acetic acid |
| DSL-65A | FF12A | FL41 | F2 | 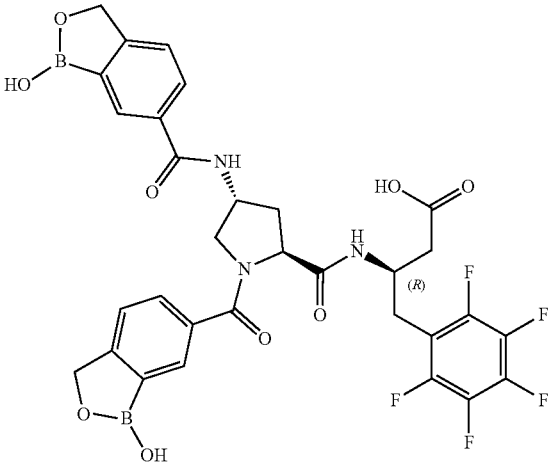<br>(R)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(perfluorophenyl)butanoic acid |
| DSL-66A | FF116A | FL3 | F2 | 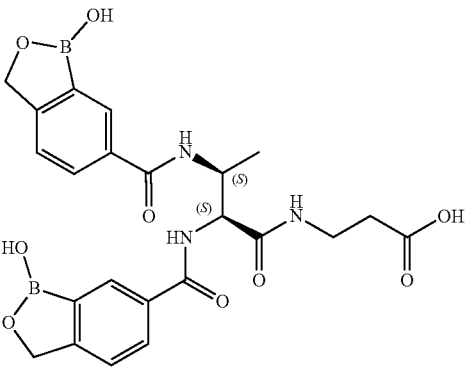<br>3-((2S,3S)-2,3-bis(1-hydroxy-1,3-dihydrobenzo[c][1,2]oxaborole-6-carboxamido)butanamido)propanoic acid |

| Compound # | FF | FL | F | Structure/IUPAC |
|---|---|---|---|---|
| DSL-67A | FF12A | FL68 | F2 | 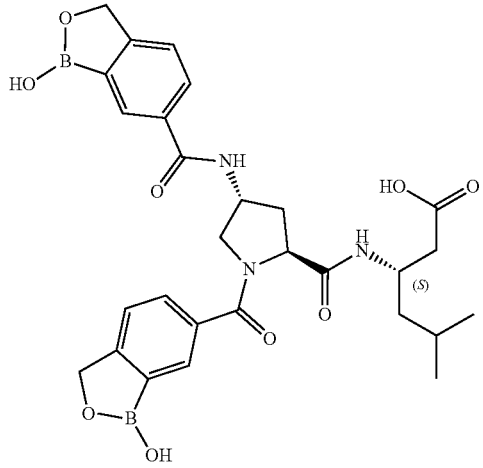<br>(S-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-5-methylhexanoic acid |
| DSL-68A | FF12A | FL3, FL69 | F2 | 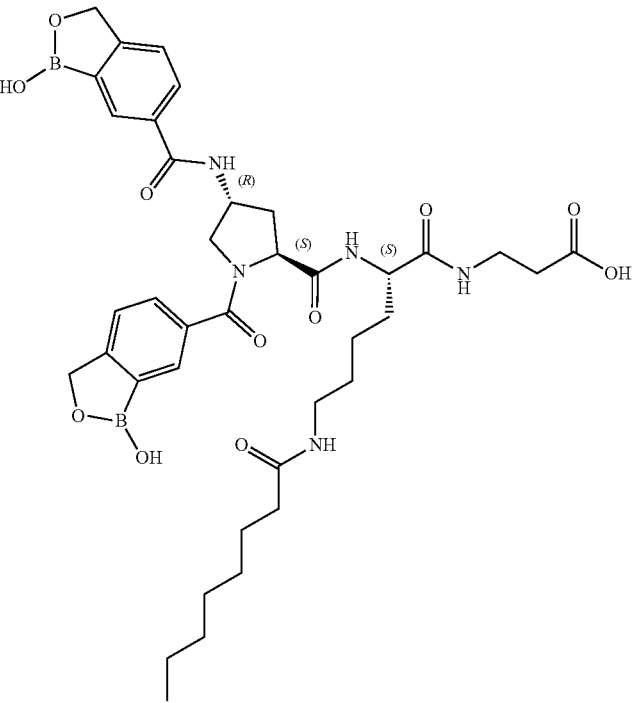<br>3-((S)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-octanamidohexanamido)propanoic acid |

TABLE 1-continued

| Compound # | FF | FL | F | Structure/IUPAC |
|---|---|---|---|---|
| DSL-69A | FF116A | FL3 | F2 | 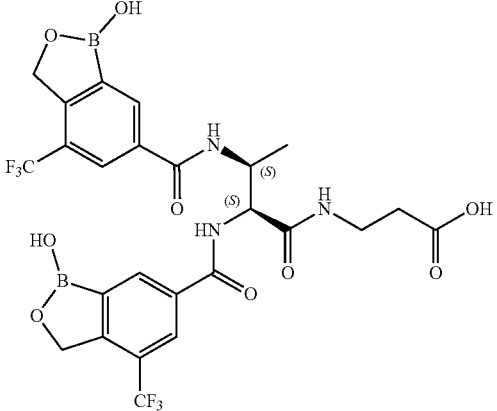<br>3-((2S,3S)-2,3-bis(1-hydroxy-4-(trifluoromethyl)-1,3-dihydrobenzo[c][1,2]oxaborole-6-carboxamido)butanamido)propanoic acid |
| DSL-70A | FF12A | FL5B | F2 | 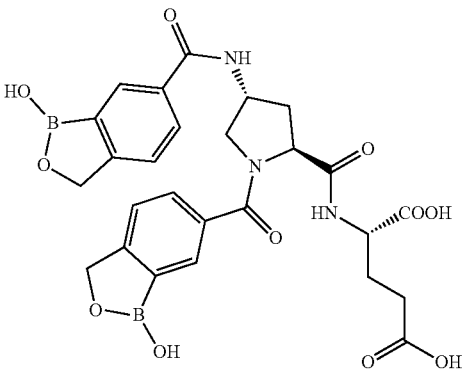 [SMILES: O=C(O)CC[C@H](NC(=O)[C@@H]1C[C@@H](NC(=O)c2ccc3c(c2)B(O)OC3)CN1C(=O)c1ccc2c(c1)B(O)OC2)C(=O)O]<br>((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-L-glutamic acid |
| DSL-71A | FF116A | FL3 | F2 | 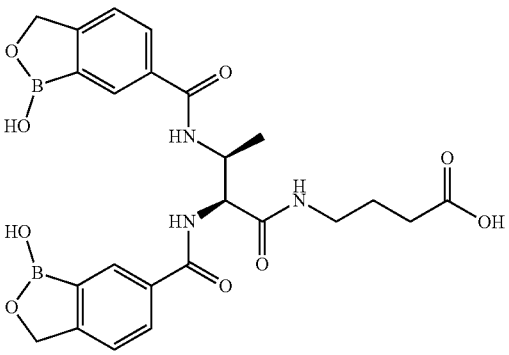 [SMILES: C[C@H](NC(=O)c1ccc2c(c1)B(O)OC2)[C@H](NC(=O)c1ccc2c(c1)B(O)OC2)C(=O)NCCCC(=O)O]<br>4-((2S,3S)-2,3-bis(1-hydroxy-1,3-dihydrobenzo[c][1,2]oxaborole-6-carboxamido)butanamido)butanoic acid |

TABLE 1-continued

| Compound # | FF | FL | F | Structure/IUPAC |
|---|---|---|---|---|
| DSL-72A | FF225B | FL3 | F2 | 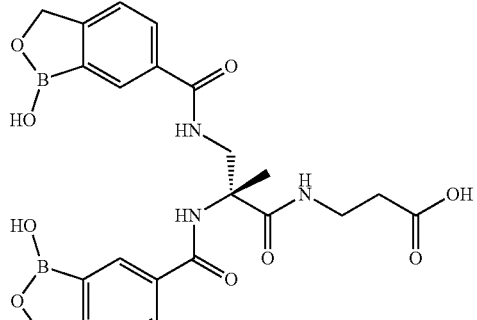<br>(R)-3-(2,3-bis(1-hydroxy-1,3-dihydrobenzo[c][1,2]oxaborole-6-carboxamido)-2-methylpropanamido)propanoic acid |
| DSL-73A | FF225A | FL3 | F2 | 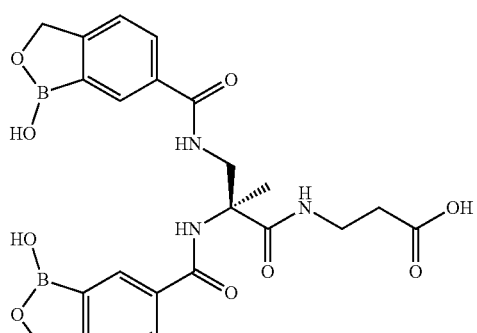<br>(S)-3-(2,3-bis(1-hydroxy-1,3-dihydrobenzo[c][1,2]oxaborole-6-carboxamido)-2-methylpropanamido)propanoic acid |
| DSL-74A | FF203 | FL3 | F2 | 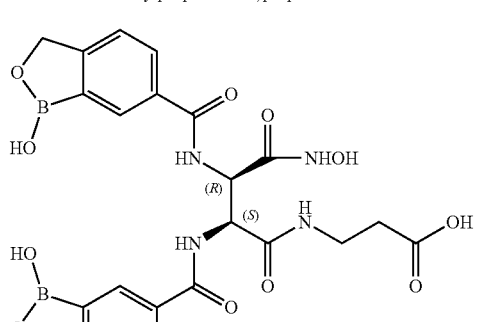<br>3-((2S,3R)-2,3-bis(1-hydroxy-1,3-dihydrobenzo[c][1,2]oxaborole-6-carboxamido)-4-(hydroxyamino)-4-oxobutanamido)propanoic acid |
| DSL-75A | FF116A | FL5B | F2 | 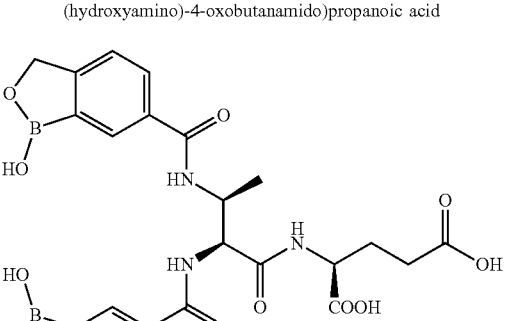 |

| Compound # | FF | FL | F | Structure/IUPAC |
|---|---|---|---|---|
| | | | | ((2S,3S)-2,3-bis(1-hydroxy-1,3-dihydrobenzo[c][1,2]oxaborole-6-carboxamido)butanoyl)-L-glutamic acid |
| DSL-76A | FF193A | FL3 | F2 | 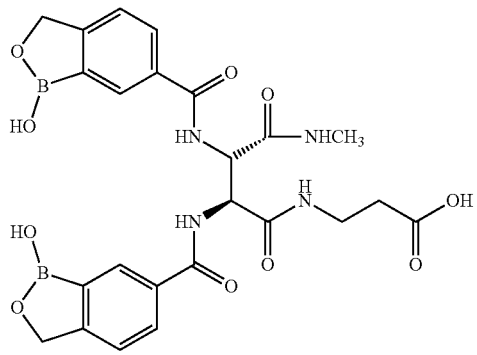 3-((2S,3S)-2,3-bis(1-hydroxy-1,3-dihydrobenzo[c][1,2]oxaborole-6-carboxamido)-4-(methylamino)-4-oxobutanamido)propanoic acid |
| DSL-77A | FF12B | FL3 | F2 | 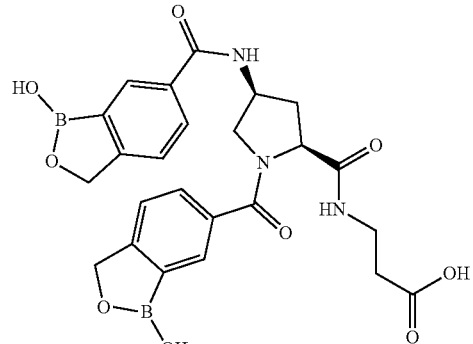 3-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |
| DSL-78A | FF116A | FL75 | F2 | 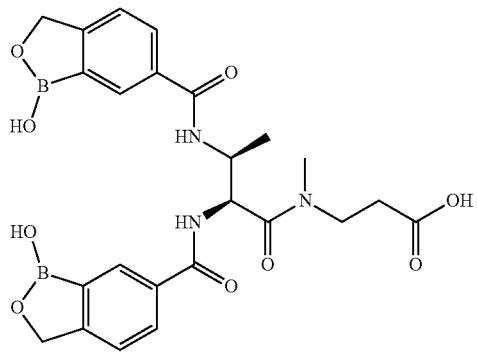 [SMILES: C[C@H](NC(=O)c1ccc2c(c1)B(O)OC2)[C@H](NC(=O)c1ccc2c(c1)B(O)OC2)C(=O)N(C)CCC(=O)O] 3-((2S,3S)-2,3-bis(1-hydroxy-1,3-dihydrobenzo[c][1,2]oxaborole-6-carboxamido)-N-methylbutanamido)propanoic acid |

TABLE 1-continued

| Compound # | FF | FL | F | Structure/IUPAC |
|---|---|---|---|---|
| DSL-79A | FF12A | FL71 | F2 | 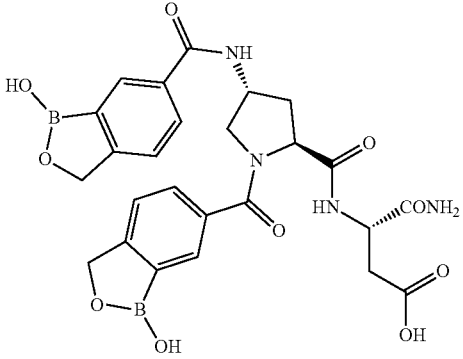 [SMILES: NC(=O)[C@H](CC(=O)O)NC(=O)[C@@H]1C[C@@H](NC(=O)c2ccc3c(c2)B(O)OC3)CN1C(=O)c1ccc2c(c1)B(O)OC2]<br>(S)-4-amino-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-oxobutanoic acid |
| DSL-80A | FF12A | FL43 | F2 | 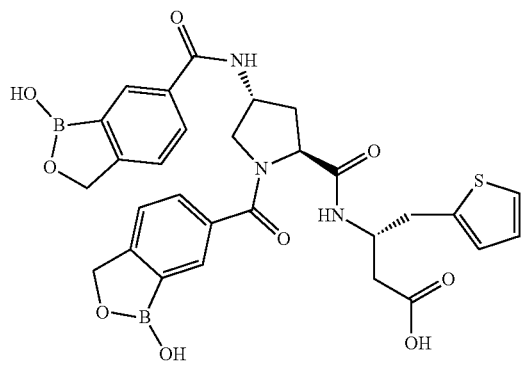 [SMILES: O=C(O)C[C@@H](Cc1cccs1)NC(=O)[C@@H]1C[C@@H](NC(=O)c2ccc3c(c2)B(O)OC3)CN1C(=O)c1ccc2c(c1)B(O)OC2]<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(thiophen-2-yl)butanoic acid |
| DSL-81A | FF12A | FL5B | F2 | 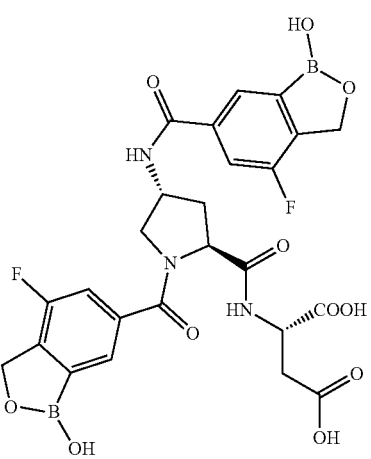 [SMILES: O=C(O)C[C@H](NC(=O)[C@@H]1C[C@@H](NC(=O)c2cc(F)c3c(c2)B(O)OC3)CN1C(=O)c1cc(F)c2c(c1)B(O)OC2)C(=O)O]<br>((2S,4R)-1-(4-fluoro-1-hydroxy-1,3-dihydrobenzo[c][1,2]oxaborole-6-carbonyl)-4-(4-fluoro-1-hydroxy-1,3-dihydrobenzo[c][1,2]oxaborole-6-carboxamido)pyrrolidine-2-carbonyl)-L-aspartic acid |

TABLE 1-continued

| Compound # | FF | FL | F | Structure/IUPAC |
|---|---|---|---|---|
| DSL-82A | FF116A | FL5B | F2 | 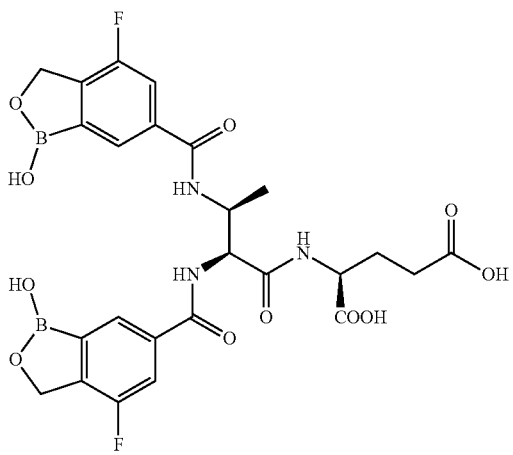 [SMILES: C[C@H](NC(=O)c1cc(F)c2c(c1)B(O)OC2)[C@H](NC(=O)c1cc(F)c2c(c1)B(O)OC2)C(=O)N[C@@H](CCC(=O)O)C(=O)O] ((2S,3S)-2,3-bis(4-fluoro-1-hydroxy-1,3-dihydrobenzo[c][1,2]oxaborole-6-carboxamido)butanoyl)-L-glutamic acid |
| DSL-83A | FF12A | FL5B | F2 | 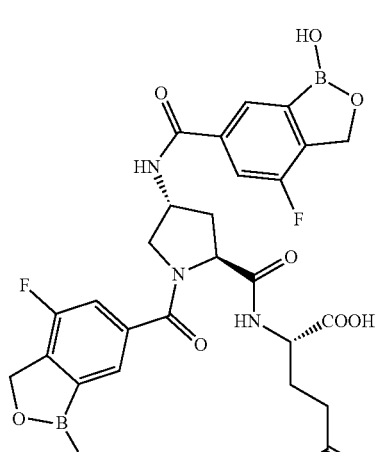 ((2S,4R)-1-(4-fluoro-1-hydroxy-1,3-dihydrobenzo[c][1,2]oxaborole-6-carbonyl)-4-(4-fluoro-1-hydroxy-1,3-dihydrobenzo[c][1,2]oxaborole-6-carboxamido)pyrrolidine-2-carbonyl)-L-glutamic acid |
| DSL-84A | FF116A | FL44 | F2 | 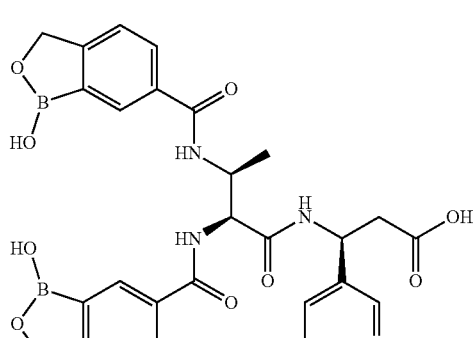 (S)-3-((2S,3S)-2,3-bis(1-hydroxy-1,3-dihydrobenzo[c][1,2]oxaborole-6-carboxamido)butanamido)-3-(pyridin-3-yl)propanoic acid |

TABLE 1-continued

| Compound # | FF | FL | F | Structure/IUPAC |
|---|---|---|---|---|
| DSL-85A | FF116A | FL72 | F2 | 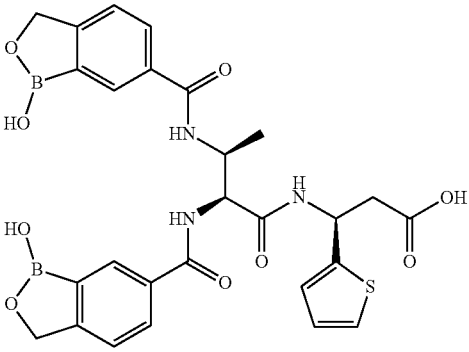 [SMILES: C[C@H](NC(=O)c1ccc2c(c1)B(O)OC2)[C@H](NC(=O)c1ccc2c(c1)B(O)OC2)C(=O)N[C@@H](CC(=O)O)c1cccs1]<br>(S)-3-((2S,3S)-2,3-bis(1-hydroxy-1,3-dihydrobenzo[c][1,2]oxaborole-6-carboxamido)butanamido)-3-(thiophen-2-yl)propanoic acid |
| DSL-86A | FF116A | FL53 | F2 | 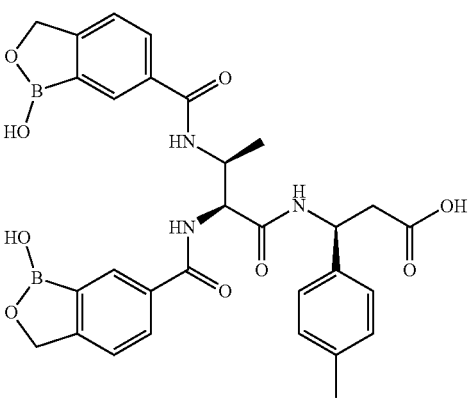 [SMILES: Cc1ccc([C@H](CC(=O)O)NC(=O)[C@@H](NC(=O)c2ccc3c(c2)B(O)OC3)[C@H](C)NC(=O)c2ccc3c(c2)B(O)OC3)cc1]<br>(S)-3-((2S,3S)-2,3-bis(1-hydroxy-1,3-dihydrobenzo[c][1,2]oxaborole-6-carboxamido)butanamido)-3-(p-tolyl)propanoic acid |
| DSL-87A | FF116A | FL73 | F2 | 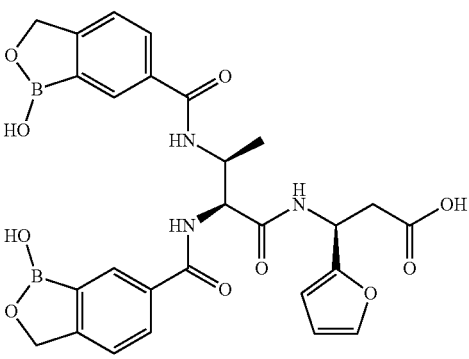 [SMILES: C[C@H](NC(=O)c1ccc2c(c1)B(O)OC2)[C@H](NC(=O)c1ccc2c(c1)B(O)OC2)C(=O)N[C@@H](CC(=O)O)c1ccco1]<br>(S)-3-((2S,3S)-2,3-bis(1-hydroxy-1,3-dihydrobenzo[c][1,2]oxaborole-6-carboxamido)butanamido)-3-(furan-2-yl)propanoic acid |

TABLE 1-continued

| Compound # | FF | FL | F | Structure/IUPAC |
|---|---|---|---|---|
| DSL-88A | FF116A | FL48 | F2 | 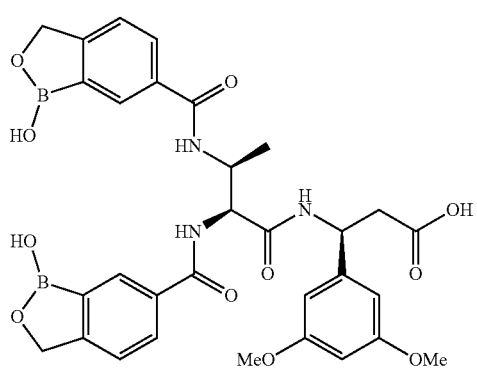 [SMILES: COc1cc(OC)cc([C@H](CC(=O)O)NC(=O)[C@@H](NC(=O)c2ccc3c(c2)B(O)OC3)[C@H](C)NC(=O)c2ccc3c(c2)B(O)OC3)c1]<br>(S)-3-((2S,3S)-2,3-bis(1-hydroxy-1,3-dihydrobenzo[c][1,2]oxaborole-6-carboxamido)butanamido)-3-(3,5-dimethoxyphenyl)propanoic acid |
| DSL-89A | FL12A | FL53 | F2 | 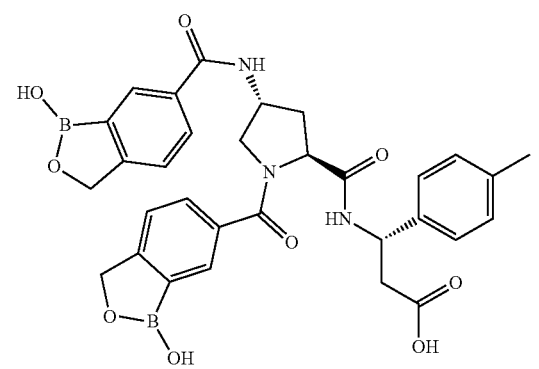 [SMILES: Cc1ccc([C@H](CC(=O)O)NC(=O)[C@@H]2C[C@@H](NC(=O)c3ccc4c(c3)B(O)OC4)CN2C(=O)c2ccc3c(c2)B(O)OC3)cc1]<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(p-tolyl)propanoic acid |
| DSL-90A | FF116A | FL68 | F2 | 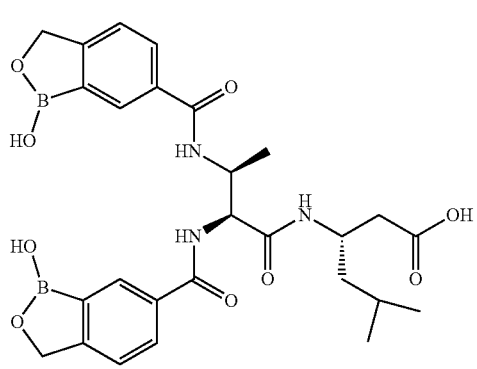 [SMILES: CC(C)C[C@@H](CC(=O)O)NC(=O)[C@@H](NC(=O)c1ccc2c(c1)B(O)OC2)[C@H](C)NC(=O)c1ccc2c(c1)B(O)OC2]<br>(S)-3-((2S,3S)-2,3-bis(1-hydroxy-1,3-dihydrobenzo[c][1,2]oxaborole-6-carboxamido)butanamido)-5-methylhexanoic acid |

TABLE 1-continued

| Compound # | FF | FL | F | Structure/IUPAC |
|---|---|---|---|---|
| DSL-91A | FF12A | FL45 | F2 | 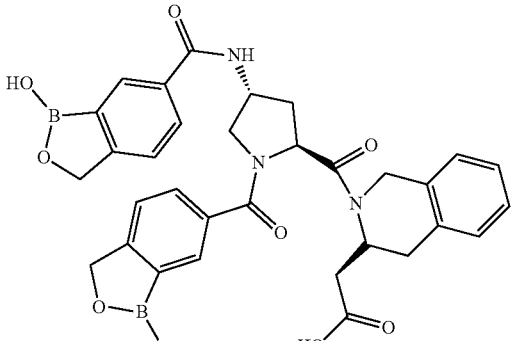<br>2-((R)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-1,2,3,4-tetrahydroisoquinolin-3-yl)acetic acid |
| DSL-92A | FF12A | FL48 | F2 | 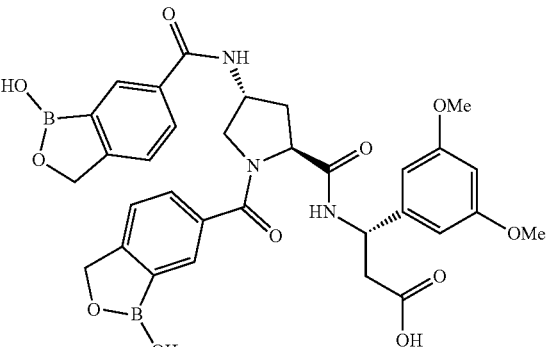<br>(S)-3-(3,5-dimethoxyphenyl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |
| DSL-93A | FF116A | FL56 | F2 | 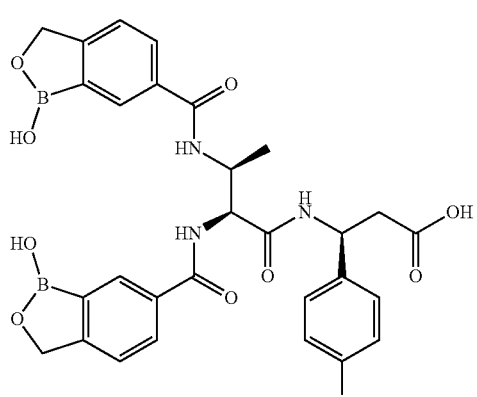<br>(S)-3-((2S,3S)-2,3-bis(1-hydroxy-1,3-dihydrobenzo[c][1,2]oxaborole-6-carboxamido)butanamido)-3-(4-fluorophenyl)propanoic acid |

TABLE 1-continued

| Compound # | FF | FL | F | Structure/IUPAC |
|---|---|---|---|---|
| DSL-94A | FF116A | FL45 | F2 | 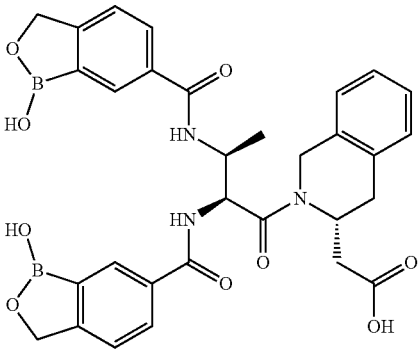 [SMILES: C[C@H](NC(=O)c1ccc2c(c1)B(O)OC2)[C@H](NC(=O)c1ccc2c(c1)B(O)OC2)C(=O)N1Cc2ccccc2C[C@@H]1CC(=O)O] 2-((R)-2-((2S,3S)-2,3-bis(1-hydroxy-1,3-dihydrobenzo[c][1,2]oxaborole-6-carboxamido)butanoyl)-1,2,3,4-tetrahydroisoquinolin-3-yl)acetic acid |
| DSL-95A | FF12A | FL50 | F2 | 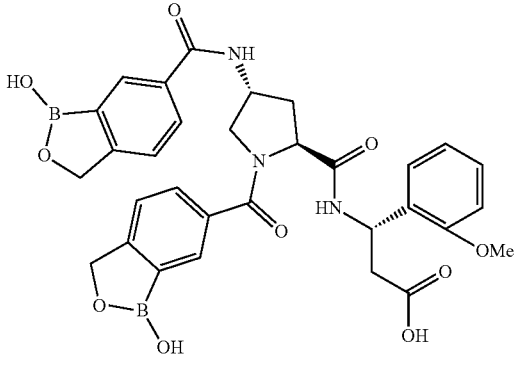 [SMILES: COc1ccccc1[C@H](CC(=O)O)NC(=O)[C@@H]1C[C@@H](NC(=O)c2ccc3c(c2)B(O)OC3)CN1C(=O)c1ccc2c(c1)B(O)OC2] (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(2-methoxyphenyl)propanoic acid |
| DSL-96A | FF116A | FL46 | F2 | 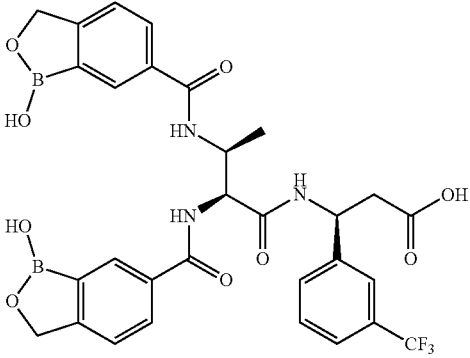 [SMILES: C[C@H](NC(=O)c1ccc2c(c1)B(O)OC2)[C@H](NC(=O)c1ccc2c(c1)B(O)OC2)C(=O)N[C@@H](CC(=O)O)c1cccc(C(F)(F)F)c1] (S)-3-((2S,3S)-2,3-bis(1-hydroxy-1,3-dihydrobenzo[c][1,2]oxaborole-6-carboxamido)butanamido)-3-(3-(trifluoromethyl)phenyl)propanoic acid |

TABLE 1-continued

| Compound # | FF | FL | F | Structure/IUPAC |
|---|---|---|---|---|
| DSL-97A | FF116A | FL50 | F2 | 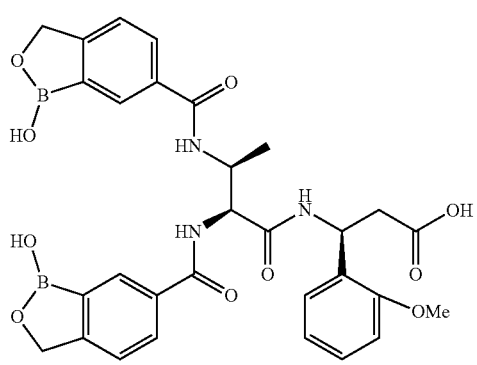 [SMILES: COc1ccccc1[C@H](CC(=O)O)NC(=O)[C@@H](NC(=O)c1ccc2c(c1)B(O)OC2)[C@H](C)NC(=O)c1ccc2c(c1)B(O)OC2]<br>(S)-3-((2S,3S)-2,3-bis(1-hydroxy-1,3-dihydrobenzo[c][1,2]oxaborole-6-carboxamido)butanamido)-3-(2-methoxyphenyl)propanoic acid |
| DSL-98A | FF12A | FL46 | F2 | 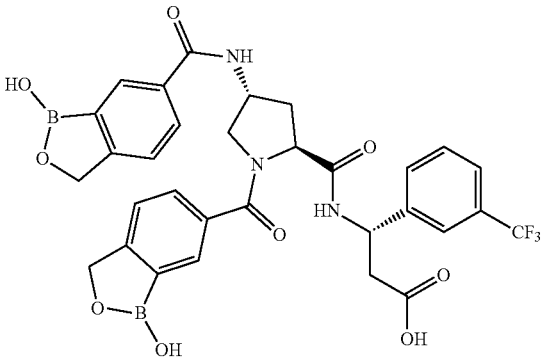 [SMILES: O=C(O)C[C@H](NC(=O)[C@@H]1C[C@@H](NC(=O)c2ccc3c(c2)B(O)OC3)CN1C(=O)c1ccc2c(c1)B(O)OC2)c1cccc(C(F)(F)F)c1]<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(3-(trifluoromethyl)phenyl)propanoic acid |
| DSL-99A | FF12A | FL73 | F2 | 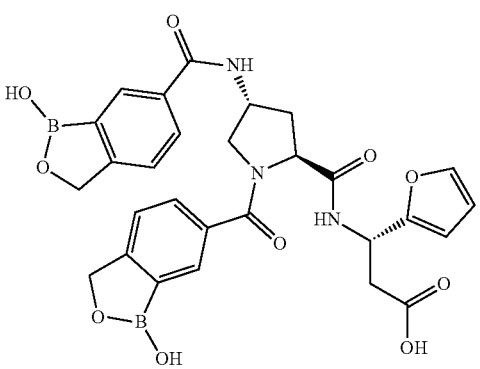 [SMILES: O=C(O)C[C@H](NC(=O)[C@@H]1C[C@@H](NC(=O)c2ccc3c(c2)B(O)OC3)CN1C(=O)c1ccc2c(c1)B(O)OC2)c1ccco1]<br>(S)-3-(furan-2-yl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |

TABLE 1-continued

| Compound # | FF | FL | F | Structure/IUPAC |
|---|---|---|---|---|
| DSL-100A | FF116A | FL55 | F2 | 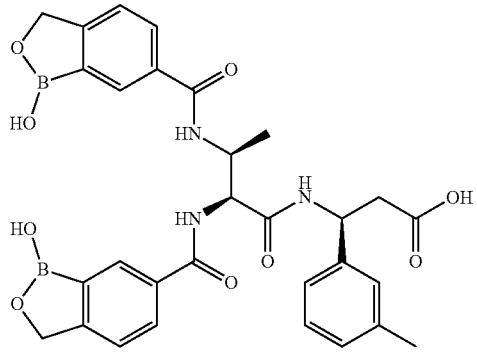 [SMILES: Cc1cccc([C@H](CC(=O)O)NC(=O)[C@@H](NC(=O)c2ccc3c(c2)B(O)OC3)[C@H](C)NC(=O)c2ccc3c(c2)B(O)OC3)c1]<br>(S)-3-((2S,3S)-2,3-bis(1-hydroxy-1,3-dihydrobenzo[c][1,2]oxaborole-6-carboxamido)butanamido)-3-(m-tolyl)propanoic acid |
| DSL-101A | FF116A | FL57 | F2 | 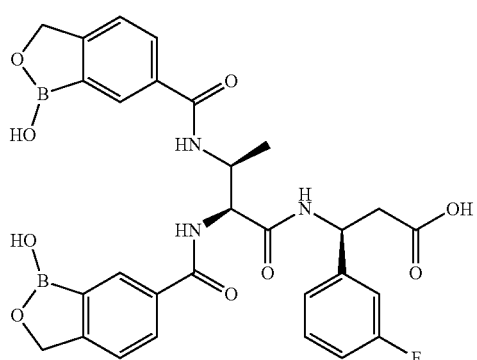<br>(S)-3-((2S,3S)-2,3-bis(1-hydroxy-1,3-dihydrobenzo[c][1,2]oxaborole-6-carboxamido)butanamido)-3-(3-fluorophenyl)propanoic acid |
| DSL-102A | FF12A | FL55 | F2 | 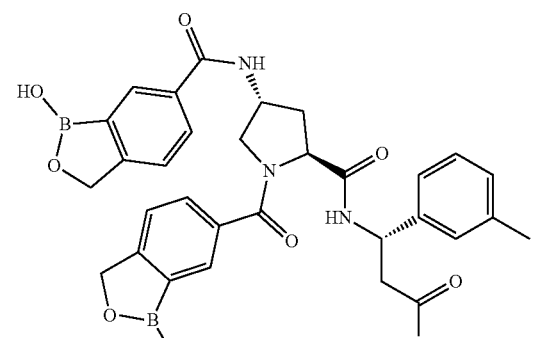<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(m-tolyl)propanoic acid |

TABLE 1-continued

| Compound # | FF | FL | F | Structure/IUPAC |
|---|---|---|---|---|
| DSL-103A | FF12A | FL57 | F2 | 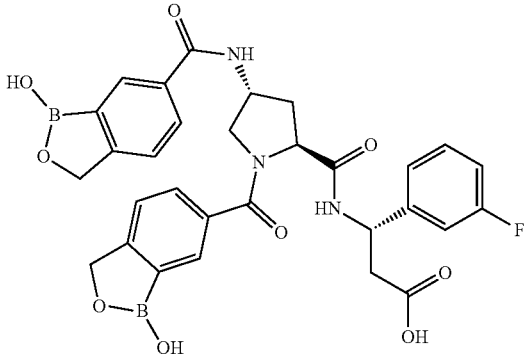 [SMILES: O=C(O)C[C@H](NC(=O)[C@@H]1C[C@@H](NC(=O)c2ccc3c(c2)B(O)OC3)CN1C(=O)c1ccc2c(c1)B(O)OC2)c1cccc(F)c1]<br>(S)-3-(3-fluorophenyl)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid |
| DSL-104A | FF115A | FL3 | F2 | 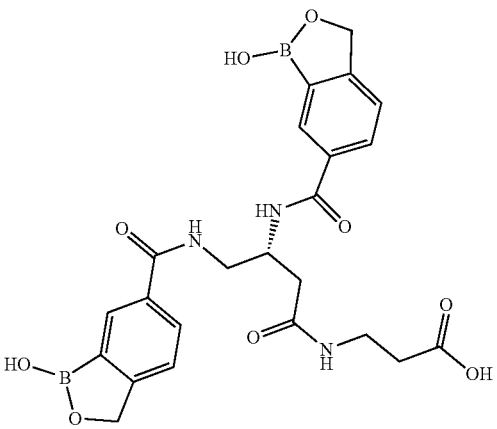 [SMILES: O=C(O)CCNC(=O)C[C@H](CNC(=O)c1ccc2c(c1)B(O)OC2)NC(=O)c1ccc2c(c1)B(O)OC2]<br>(R)-3-(3,4-bis(1-hydroxy-1,3-dihydrobenzo[c][1,2]oxaborole-6-carboxamido)butanamido)propanoic acid |
| DSL-105A | FF12A | FL74 | F2 | 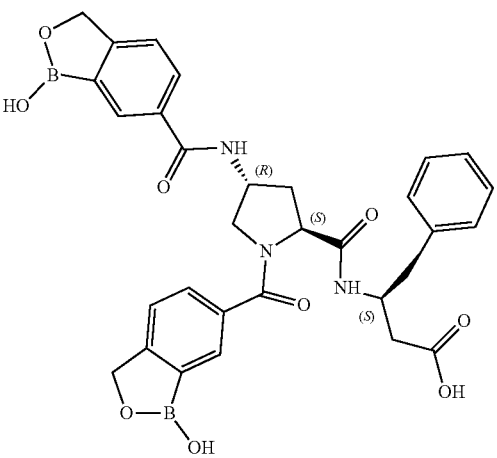<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-phenylbutanoic acid |

TABLE 1-continued

| Compound # | FF | FL | F | Structure/IUPAC |
|---|---|---|---|---|
| DSL-106A | FF114A | FL3 | F2 | 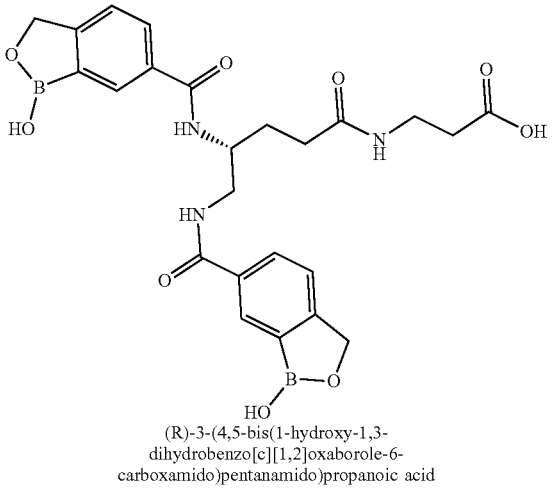<br>(R)-3-(4,5-bis(1-hydroxy-1,3-dihydrobenzo[c][1,2]oxaborole-6-carboxamido)pentanamido)propanoic acid |
| DSL-107A | FF12A | FL65 | F2 | 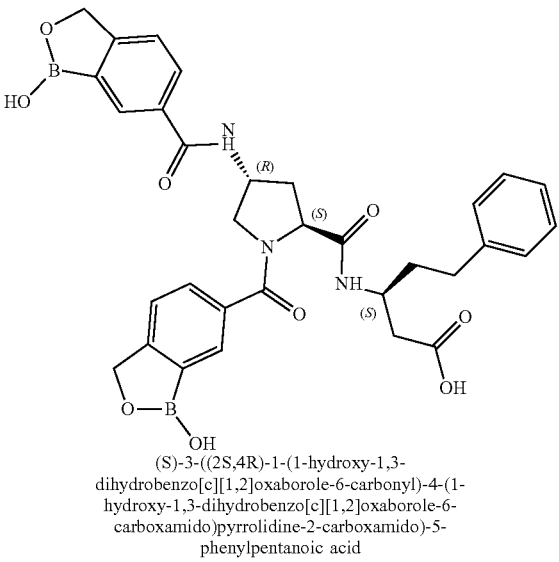<br>(S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-5-phenylpentanoic acid |
| DSL-108A | FF12B | FL3 | F2 | 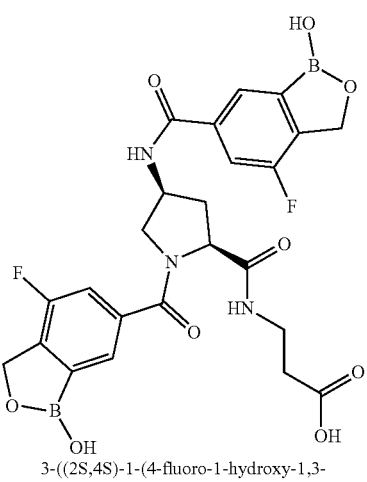<br>3-((2S,4S)-1-(4-fluoro-1-hydroxy-1,3-dihydrobenzo[c][1,2]oxaborole-6-carbonyl)-4-(4-fluoro-1-hydroxy-1,3-dihydrobenzo[c][1,2]oxaborole-6-carboxamido)pyrrolidine-2-carboxamido)propanoic acid |

TABLE 1-continued

| Compound # | FF | FL | F | Structure/IUPAC |
|---|---|---|---|---|
| DSL-109A | FF116A | FL3 | F2 | 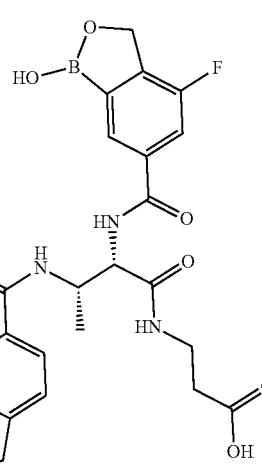<br>3-((2S,3S)-2-(4-fluoro-1-hydroxy-1,3-dihydrobenzo[c][1,2]oxaborole-6-carboxamido)-3-(1-hydroxy-1,3-dihydrobenzo[c][1,2]oxaborole-6-carboxamido)butanamido)propanoic acid |
| DSL-110A | FF116A | FL3 | F2 | 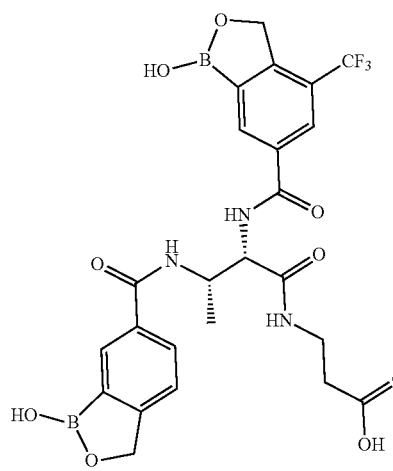<br>3-((2S,3S)-3-(1-hydroxy-1,3-dihydrobenzo[c][1,2]oxaborole-6-carboxamido)-2-(1-hydroxy-4-(trifluoromethyl)-1,3-dihydrobenzo[c][1,2]oxaborole-6-carboxamido)butanamido)propanoic acid |
| DSL-111A | FF12A | FL59 | F2 | 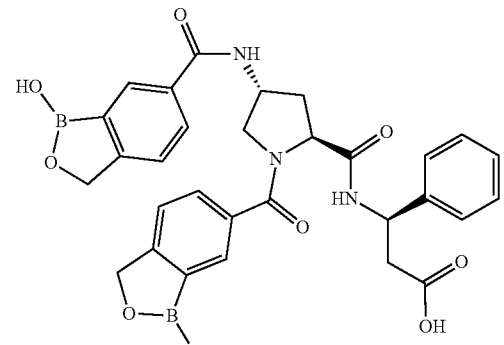<br>(R)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-phenylpropanoic acid |

TABLE 1-continued

| Compound # | FF | FL | F | Structure/IUPAC |
|---|---|---|---|---|
| DSL-112A | FF12A | FL44 | F2 | 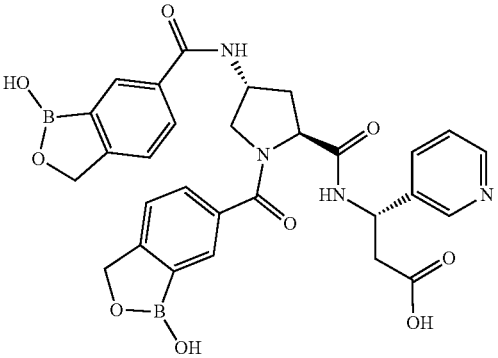 [SMILES: O=C(O)C[C@H](NC(=O)[C@@H]1C[C@@H](NC(=O)c2ccc3c(c2)B(O)OC3)CN1C(=O)c1ccc2c(c1)B(O)OC2)c1cccnc1] (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-3-(pyridin-3-yl)propanoic acid |

Synthesis of Compounds of Formula I

Synthesis of Compounds of Formula I

Illustrative synthesis protocols are provided that can be used to synthesize the examples described.

The lines connecting cysteine residues are disulfide bonds. For the sake of clarity, the H— at the N-terminus of the A- and B-chain of insulin is not histidine, it is the hydrogen of the N-terminus. The —OH shown at the C-terminal end of the A- and B-chain is the C-terminus of the respective chain.

Insulin Expression and Conjugation Method 1

1a. Expression of Proinsulin

Proinsulin can be expressed using standard IPTG induction of IPTG inducible expression constructs and vectors in *E. coli* strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired single-chain proinsulin can be performed via known procedures in the art. See, e.g., U.S. Pat. Nos. 5,457,066, 5,700,662, 5,514,646, 9,050,371, and 10,400,021.

1b. Conjugation of Diboronate Sensor 11 with Proinsulin.

To a solution of single-chain proinsulin 12 (20 mg) in DMSO (200 uL) was added 2,5-dioxopyrrolidin-1-yl 3-((2S, 3S)-2,3-bis(1-hydroxy-1,3-dihydrobenzo[c][1,2]oxaborole-6-carboxamido)butanamido)propanoate (11, DSL-66B, 4.4 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate the proinsulin conjugate intermediate 13. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM $CaCl_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Crude solution was allowed to stir at r.t for 16 hours. The crude conjugated insulin conjugate was precipitated with TFA (~200 uL), centrifuged, decanted. Then crude precipitate was washed with water (2×500 uL) then dissolved in DMSO (100-200 uL), diluted with 20% ACN/Water (5-10 mL), and purified by reverse-phase HPLC. Fractions were collected, frozen, and lyophilized to yield a white powder (5-10 mg) of 14 (Example 19).

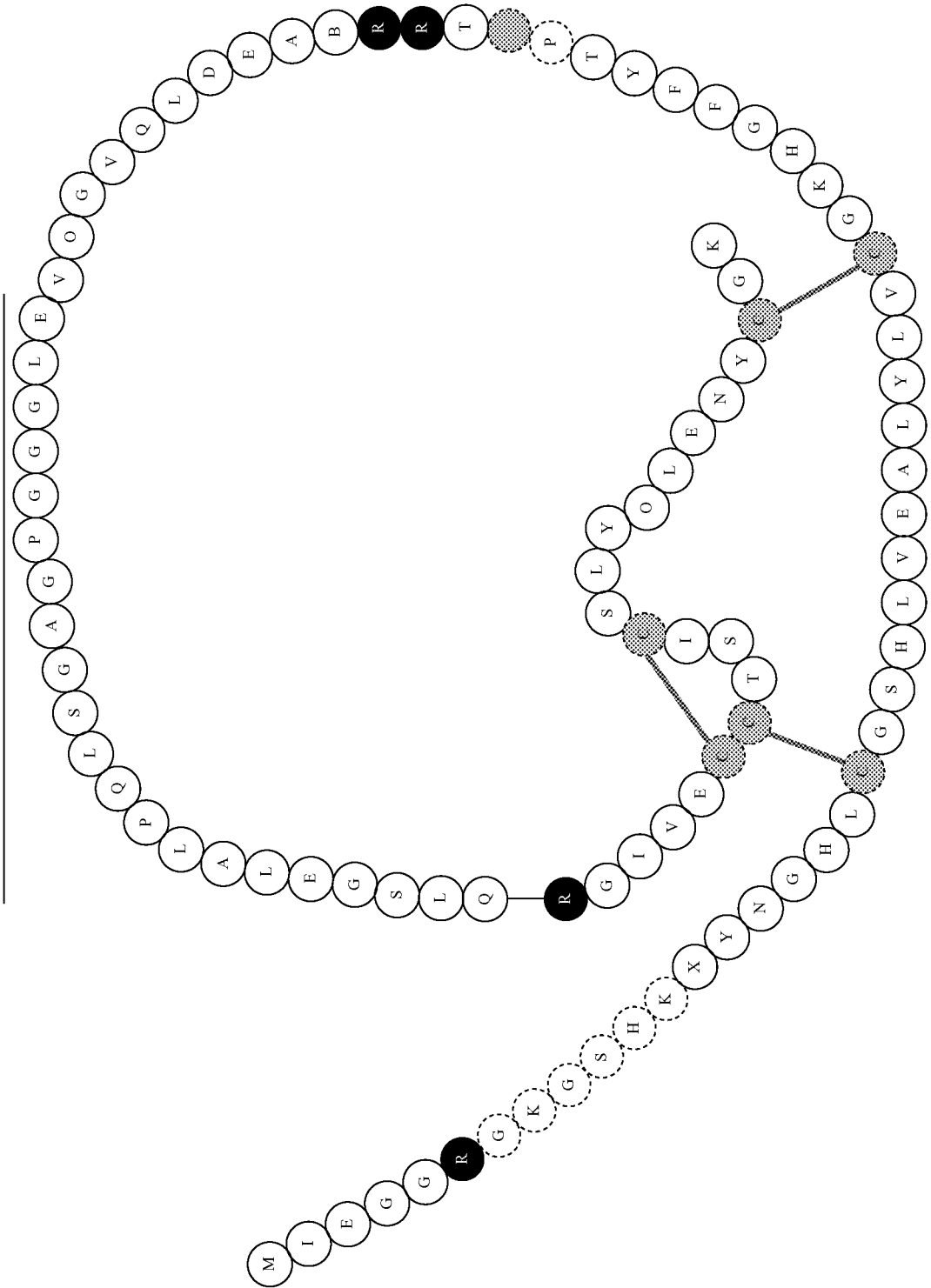
Scheme 1. Conjugation of diboronate sensor (11) with proinsulin (12) (SEQ ID NOS 25706-25707 and 25434-25435, respectively, in order of appearance).

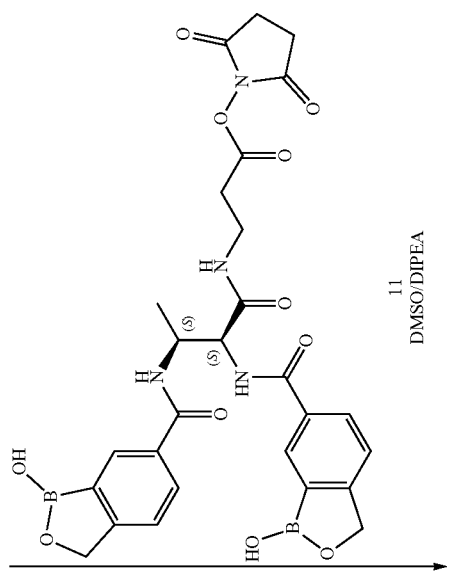
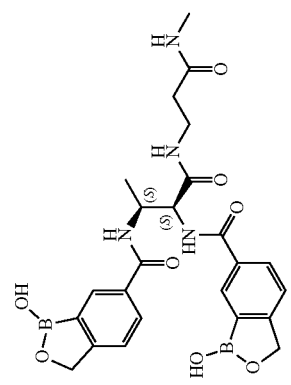

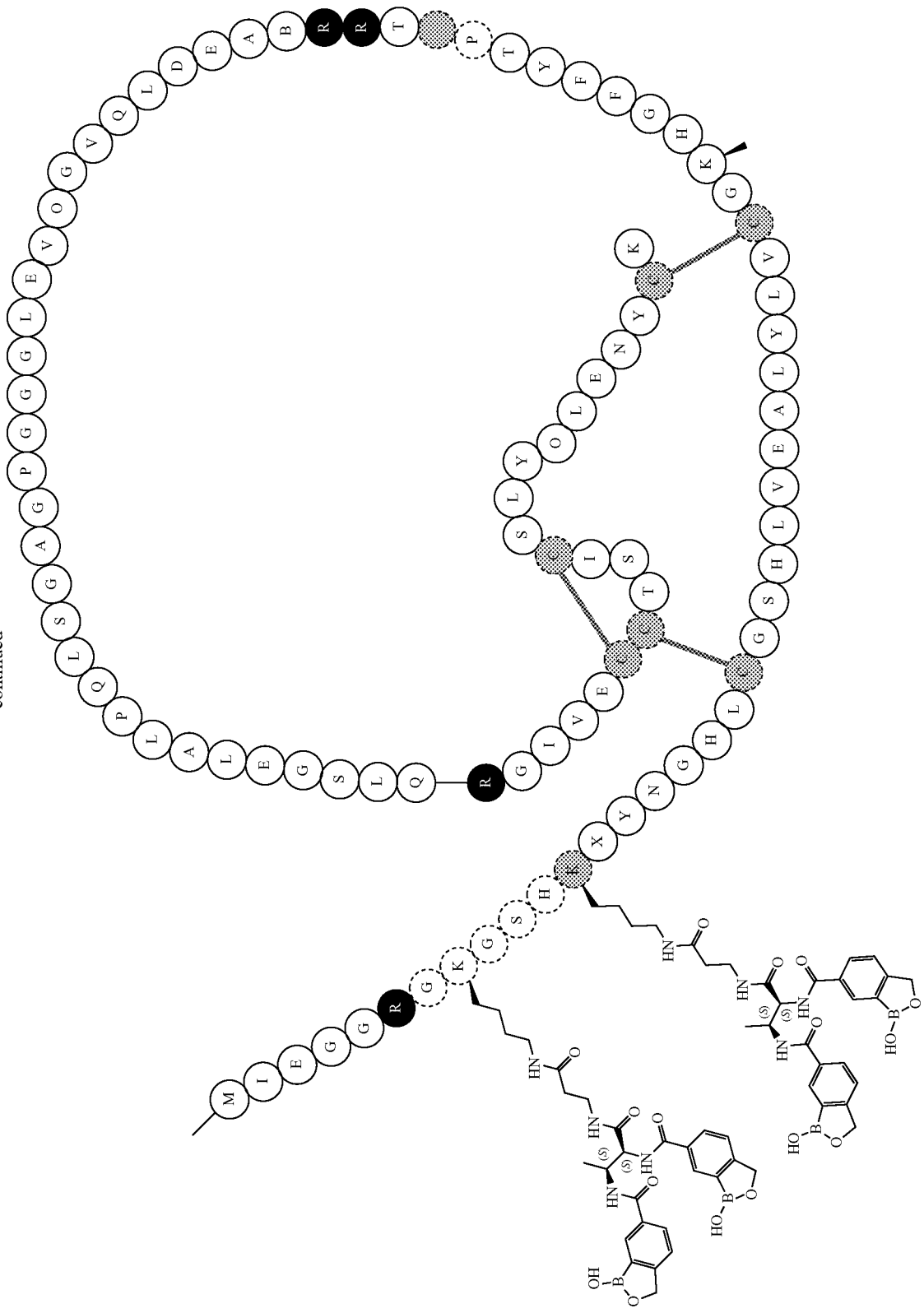

-continued
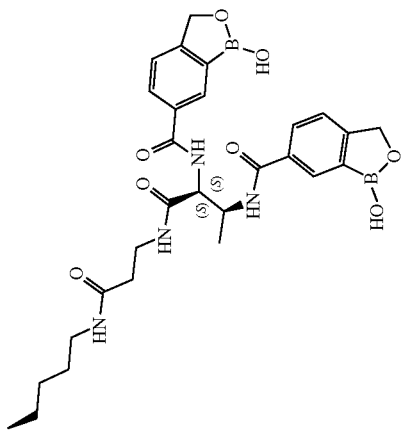
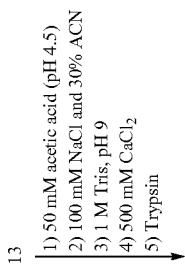
1) 50 mM acetic acid (pH 4.5)
2) 100 mM NaCl and 30% ACN
3) 1 M Tris, pH 9
4) 500 mM CaCl$_2$
5) Trypsin -continued
551
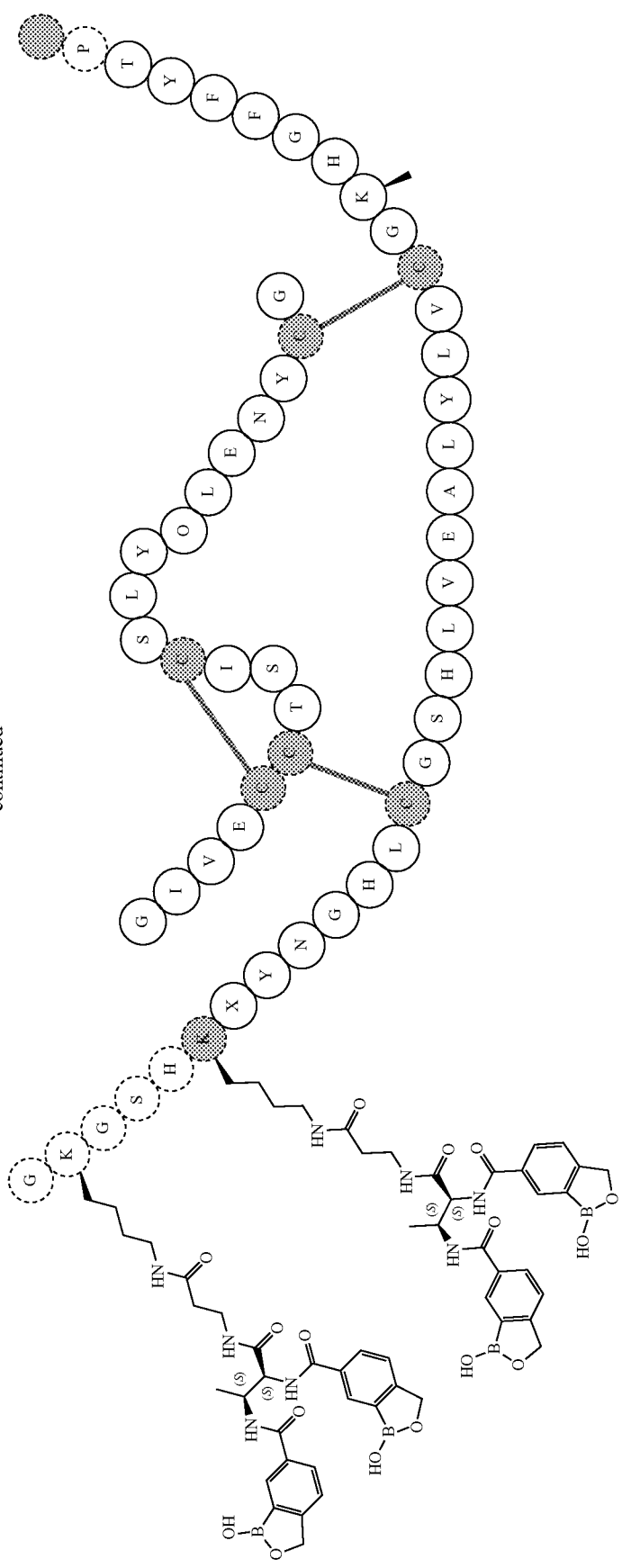
552
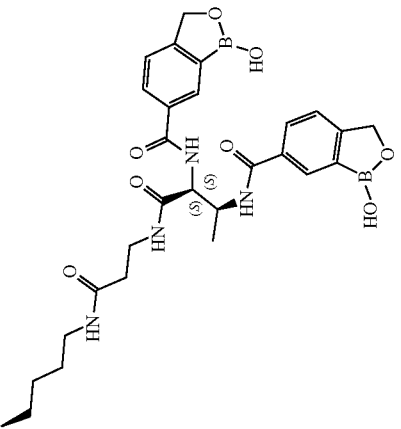

The MS data for Example 19 (compound 14) is listed in Table A The other examples listed in Table A below were synthesized under similar conditions.

TABLE A

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 19 | 7797.47 | 1549.695 | 1549.4580 | 1291.581 | 1291.4125 |
| Example 41 | 8001.44 | 1590.489 | 1590.4195 | 1325.576 | 1325.4336 |
| Example 42 | 7833.47 | 1556.895 | 1556.5677 | 1297.581 | 1297.3340 |
| Example 43 | 7833.47 | 1556.895 | | 1297.581 | |
| Example 44 | 7917.57 | 1573.715 | 1573.7895 | 1311.598 | 1311.6387 |
| Example 45 | 7995.61 | 1589.323 | 1589.1750 | 1324.604 | 1324.5053 |
| Example 46 | 7884.55 | 1567.111 | | 1306.094 | |
| Example 47 | 8046.58 | 1599.517 | | 1333.099 | |
| Example 49 | 8013.54 | 1592.909 | | 1327.593 | |
| Example 50 | 7965.44 | 1583.289 | 1583.2360 | 1319.576 | 1319.5296 |
| Example 51 | 7953.57 | 1580.915 | | 1317.598 | |
| Example 52 | 8115.60 | 1613.321 | | 1344.603 | |
| Example 53 | 7920.55 | 1574.311 | | 1312.094 | |
| Example 54 | 8010.58 | 1592.317 | | 1327.099 | |
| Example 55 | 8205.40 | 1631.281 | 1631.4997 | 1359.569 | 1359.5781 |
| Example 56 | 7929.44 | 1576.089 | | 1313.576 | |
| Example 57 | 7839.52 | 1558.105 | | 1298.589 | |
| Example 58 | 8151.60 | 1620.521 | | 1350.603 | |
| Example 59 | 8379.41 | 1666.083 | | 1388.571 | |
| Example 60 | 7962.49 | 1582.699 | | 1319.084 | |
| Example 61 | 7833.47 | 1556.895 | | 1297.581 | |
| Example 62 | 8151.60 | 1620.521 | | 1350.603 | |
| Example 63 | 7923.51 | 1574.903 | | 1312.588 | |
| Example 64 | 8337.47 | 1657.695 | | 1381.581 | |
| Example 65 | 7965.55 | 1583.311 | | 1319.594 | |
| Example 66 | 8178.60 | 1625.921 | | 1355.103 | |
| Example 67 | 8004.65 | 1591.131 | | 1326.111 | |
| Example 68 | 7995.61 | 1589.323 | | 1324.604 | |
| Example 70 | 7929.55 | 1576.111 | | 1313.594 | |
| Example 71 | 8373.47 | 1664.895 | 1664.8339 | 1387.581 | 1387.5842 |
| Example 72 | 8001.55 | 1590.511 | | 1325.594 | |
| Example 73 | 7995.61 | 1589.323 | | 1324.604 | |
| Example 74 | 8040.65 | 1598.331 | | 1332.111 | |
| Example 76 | 7905.42 | 1571.285 | 1571.3102 | 1309.573 | 1309.5893 |
| Example 77 | 7965.55 | 1583.311 | | 1319.594 | |
| Example 78 | 8037.44 | 1597.689 | | 1331.576 | |
| Example 79 | 8121.48 | 1614.497 | | 1345.583 | |
| Example 83 | 7959.61 | 1582.123 | | 1318.604 | |
| Example 84 | 7959.61 | 1582.123 | | 1318.604 | |
| Example 85 | 7917.57 | 1573.715 | | 1311.598 | |
| Example 86 | 8049.54 | 1600.109 | | 1333.593 | |
| Example 87 | 8596.07 | 1709.415 | 1709.4965 | 1424.681 | 1424.7392 |
| Example 145 | 7797.47 | 1549.695 | 1549.6064 | 1291.581 | 1291.4941 |
| Example 146 | 8103.61 | 1610.923 | 1611.0307 | 1342.604 | 1342.5192 |
| Example 147 | 7839.52 | 1558.105 | 1558.0749 | 1298.589 | 1298.5543 |
| Example 148 | 8145.66 | 1619.333 | 1619.5586 | 1349.613 | 1349.6242 |
| Example 149 | 7941.42 | 1578.485 | 1578.3760 | 1315.573 | 1315.5098 |
| Example 152 | 7851.45 | 1560.491 | 1560.3640 | 1300.578 | 1300.4802 |
| Example 154 | 7971.49 | 1584.499 | 1584.6594 | 1320.584 | 1320.56091 |
| Example 155 | 8061.57 | 1602.515 | 1602.4331 | 1335.598 | 1335.4232 |

Insulin Expression and Conjugation Method 2

2a. Expression of Proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired single-chain proinsulin can be performed via known procedures in the art. See, e.g., 5,457,066, 5,700,662, 5,514,646, 9,050,371, and 10,400,021.

2b. Conjugation of Diboronate Sensor DSL-51 with Proinsulin.

To a solution of single-chain proinsulin 15 (20 mg) in DMSO (200 uL) was added (S)-2-((2S,3S)-2,3-bis(1-hydroxy-4-(trifluoromethyl)-1,3-dihydrobenzo[1c][1,2]oxaborole-6-carboxamido)butanamido)-6-(2,5-dioxopyrrolidin-1-yl)-5-oxohexanoic acid (DSL-51B, 6.2 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 15i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$) (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) and carboxy peptidase (CBP, 1:1000 carboxy peptidase to insulin mass) was added. Insulin mixture was allowed to stir at r.t for 16 hr. The crude conjugated insulin was precipitated with TFA (~200 uL) and the solution was centrifuged, decanted, and the precipitate was dissolved in DMSO (100-200 uL), diluted into 20% ACN/Water (5-10 mL), and purified by reverse-phase HPLC. Fractions were collected, frozen, and lyophilized to yield a white powder (6 mg) of Example 11.

Alternatively, proinsulin 15 was treated with tert-butyl (S)-2-((2S,3S)-2,3-bis(1-hydroxy-4-(trifluoromethyl)-1,3-dihydrobenzo[c][1,2]oxaborole-6-carboxamido)butanamido)-6-(2,5-dioxopyrrolidin-1-yl)-5-oxohexanoate (DSL-51-OtBu) under similar conditions as described above. After digestions and precipitation, the crude conjugate was dissolved in TFA:H2O (95:5), allowed to stir for 1 hour, concentrated under reduced pressure, dissolved in DMSO (100-200 uL), diluted into 20% ACN/Water (5-10 mL), and purified by reverse-phase HPLC. Fractions were collected, frozen, and lyophilized to yield Example 11.

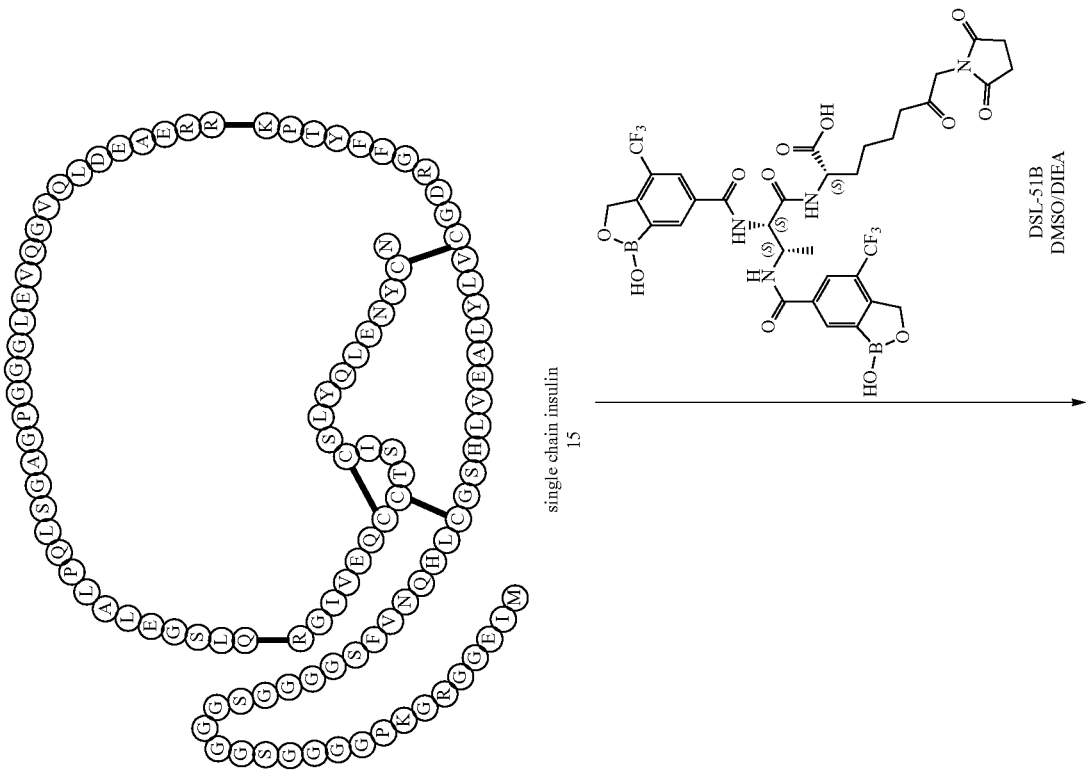
Scheme 2. Conjugation of DSL-51B with proinsulin 15 (SEQ ID NOS 25708-25709 and 25418-25419, respectively, in order of appearance).

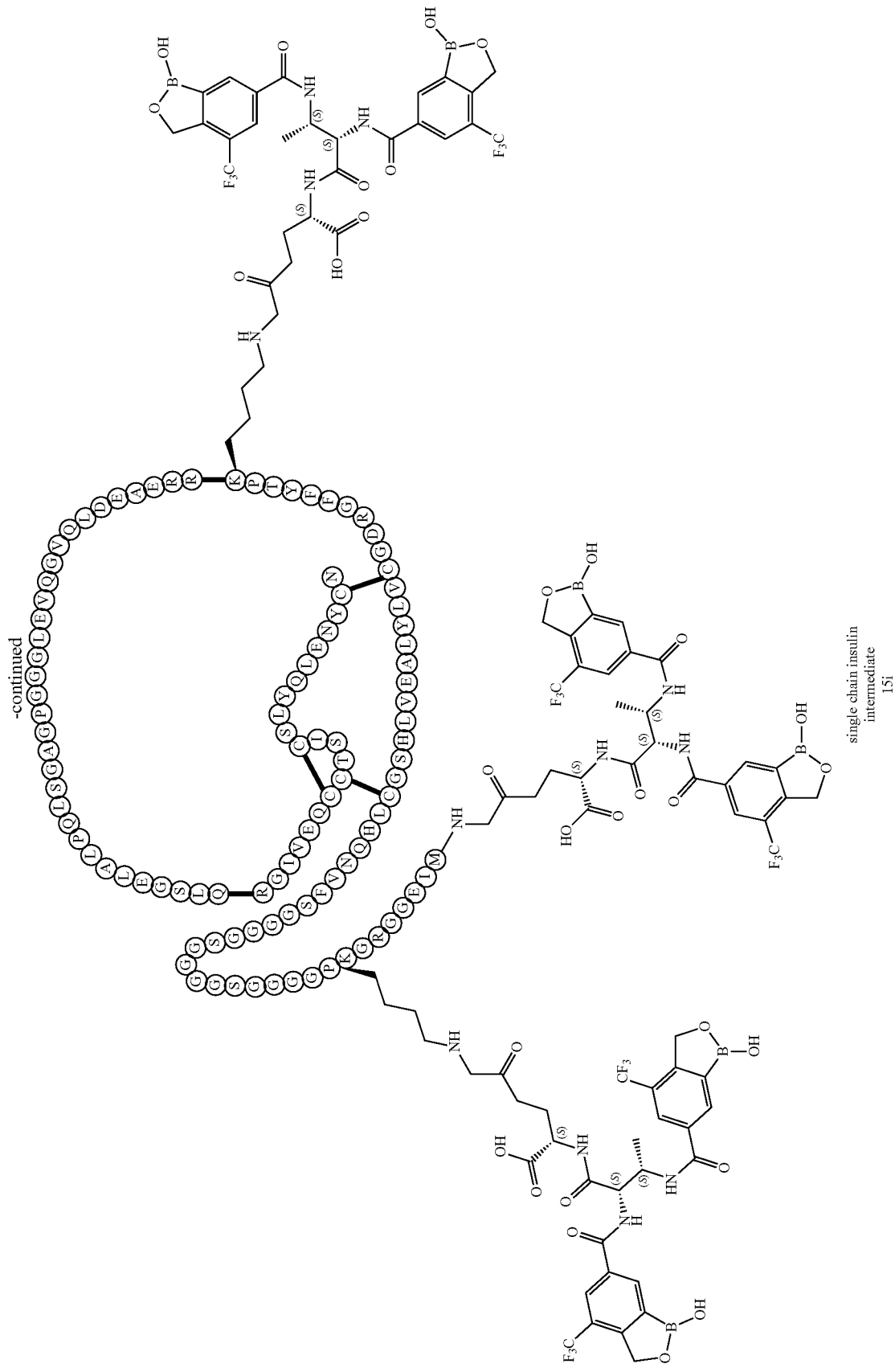
-continued
single chain insulin intermediate 15i

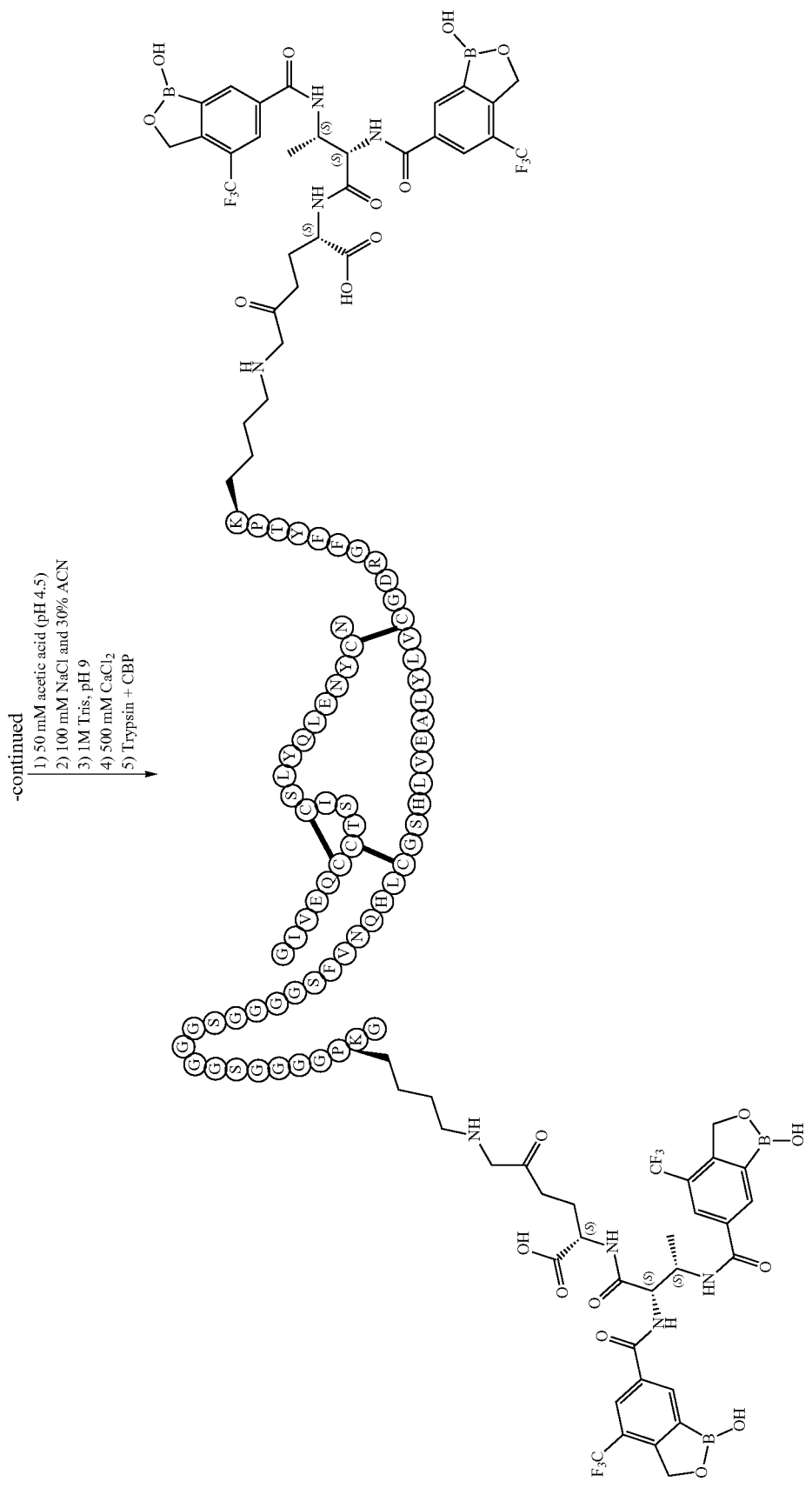
Example 11

The MS data for Example 2 is listed in Table B. The other examples listed in Table B below were synthesized under similar conditions.

TABLE B

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 2 | 8170.38 | 1627.88 | 1627.8299 | 1356.73 | 1356.6901 |
| Example 6 | 8034.41 | 1597.083 | | 1331.071 | |
| Example 11 | 8286.39 | 1647.479 | 1647.4054 | 1373.068 | 1373.0243 |
| Example 13 | 8310.39 | 1652.279 | | 1377.068 | |
| Example 18 | 8170.38 | 1624.277 | | 1353.733 | |
| Example 20 | 8310.39 | 1652.279 | | 1377.068 | |
| Example 22 | 8282.36 | 1646.673 | | 1372.396 | |

Insulin Expression and Conjugation Method 3

3a. Expression of Proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700, 662, 5,514,646, 9,050,371, and 10,400,021.

3b. Conjugation of Diboronate Sensor DSL-58B with Proinsulin.

To a solution of one-chain proinsulin 16 (20 mg) in DMSO (200 uL) was added 2,5-dioxopyrrolidin-1-yl (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(4-methoxyphenyl)butanoate (DSL-58B, 5.3 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 16i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 141 as a white powder (8.2 mg).

Scheme 3. Conjugation of DSL-58B with proinsulin 16 (SEQ ID NOS 25710-25711 and 25674-25675, respectively, in order

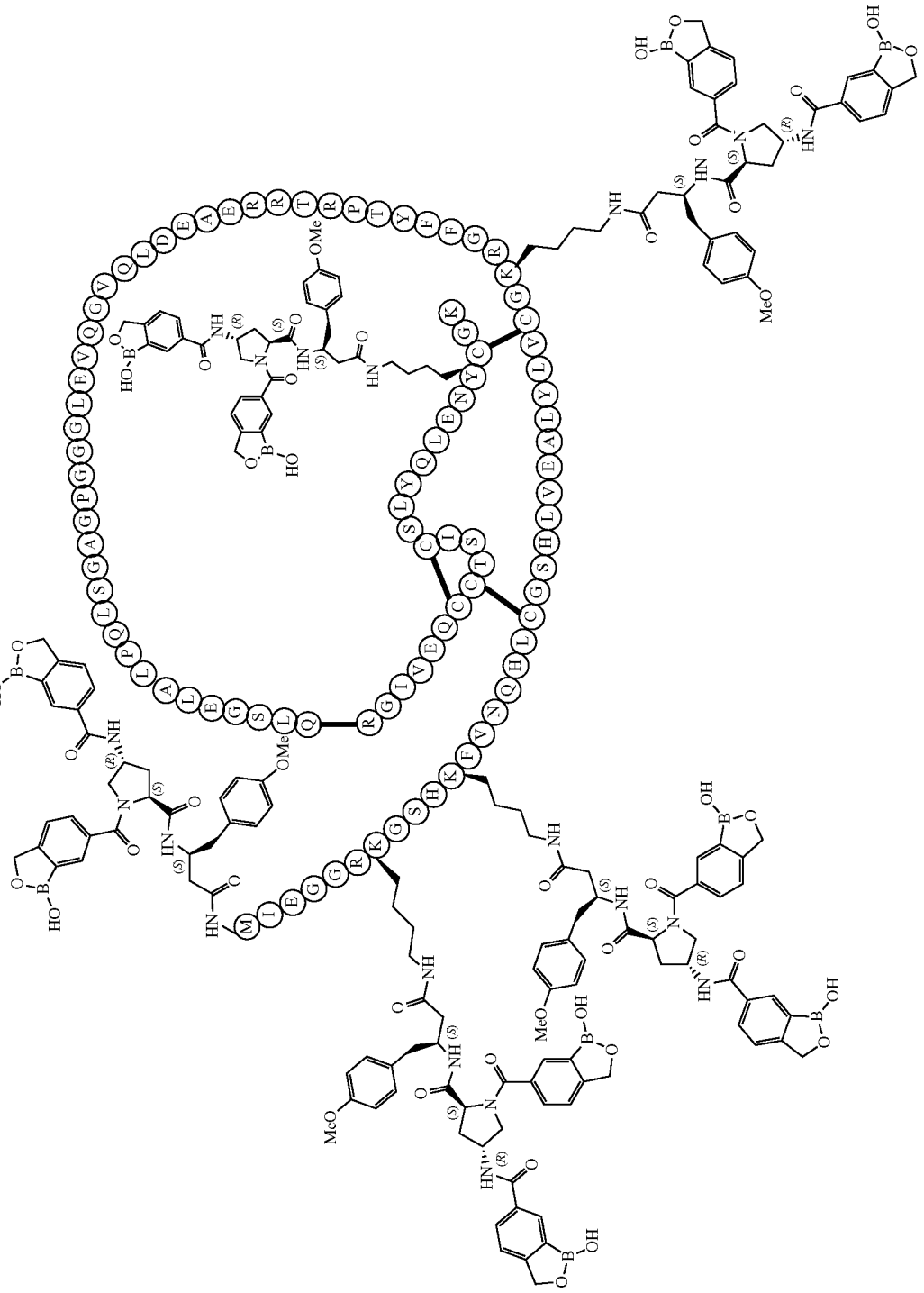
single chain insulin intermediate 16i

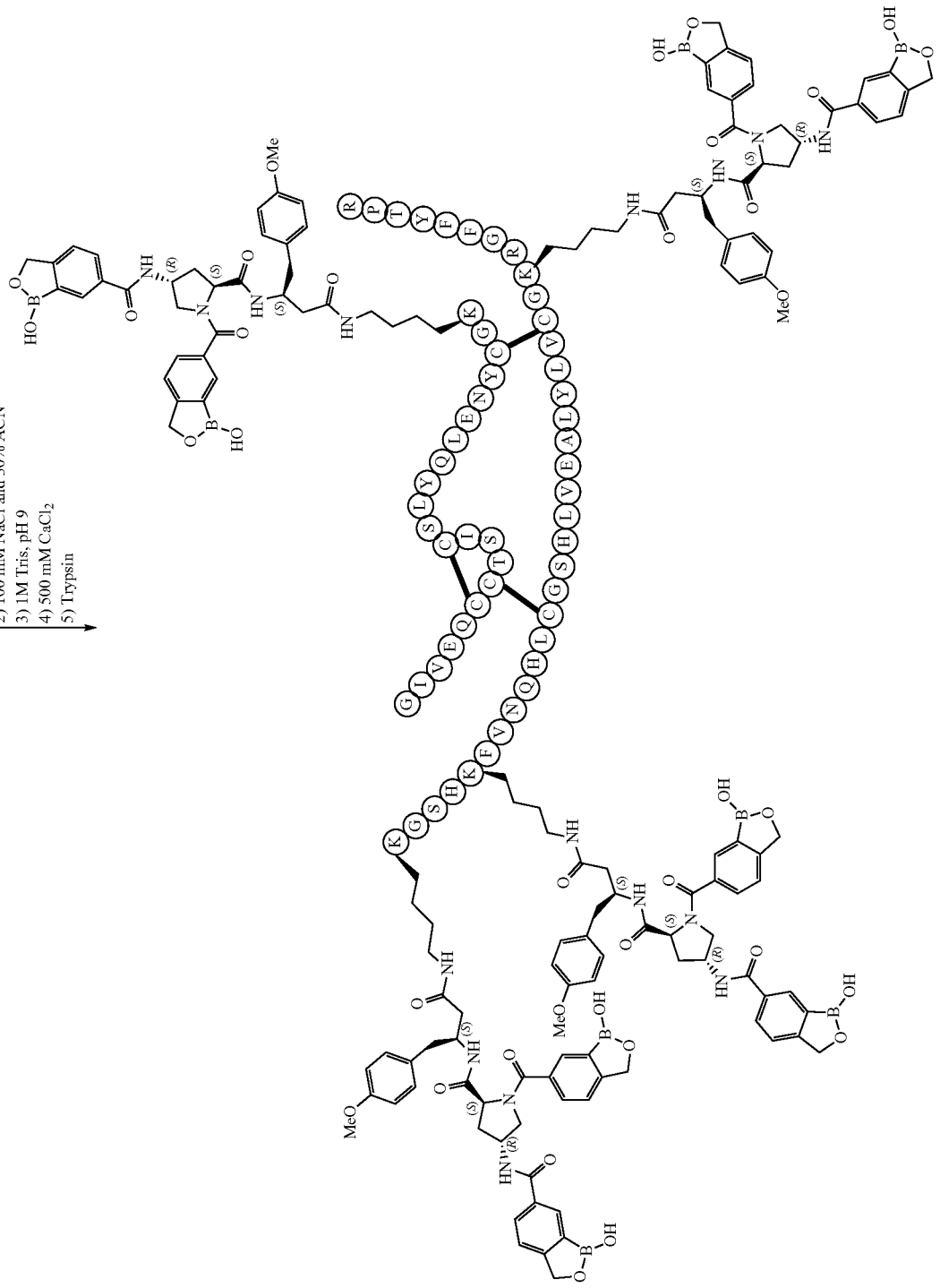
-continued
1) 50 mM acetic acid (pH 4.5)
2) 100 mM NaCl and 30% ACN
3) 1M Tris, pH 9
4) 500 mM CaCl$_2$
5) Trypsin
Example 141

The MS data for Example 141 is listed in Table C. The other examples listed in Table C below were synthesized under similar conditions.

TABLE C

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 140 | 8446.62 | 1679.525 | 1679.0139 | 1399.773 | 1399.1890 |
| Example 141 | 8830.92 | 1756.385 | 1756.3025 | 1463.823 | 1463.6154 |
| Example 142 | 8350.69 | 1660.339 | 1660.1569 | 1383.784 | 1383.6989 |
| Example 143 | 8566.88 | 1703.577 | 1703.8767 | 1419.816 | 1419.0679 |
| Example 144 | 8302.69 | 1650.739 | 1650.3696 | 1375.784 | 1375.6896 |

Insulin Expression and Conjugation Method 4

4a. Expression of Proinsulin

Proinsulin can be expressed using standard IPTG induction of IPTG inducible expression constructs and vectors in *E. coli* strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

4b. Conjugation of Diboronate Sensor DSL-66 with Proinsulin 18.

To a solution of one-chain proinsulin 18 (20 mg) in DMSO (200 uL) was added 2,5-dioxopyrrolidin-1-yl 3-((2S,3S)-2,3-bis(1-hydroxy-1,3-dihydrobenzo[c][1,2]oxaborole-6-carboxamido)butanamido)propanoate (DSL-66B, 6.2 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 18i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$) (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 69 as a white powder (7 mg).

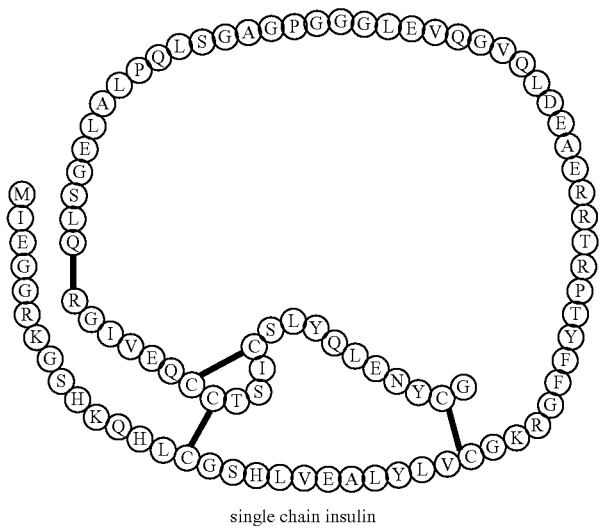

Scheme 4. Conjugation of DSL-66B with proinsulin 18 (SEQ ID NOS 25712-25713 and 25530-25531, respectively, in order of appearance).

single chain insulin
18

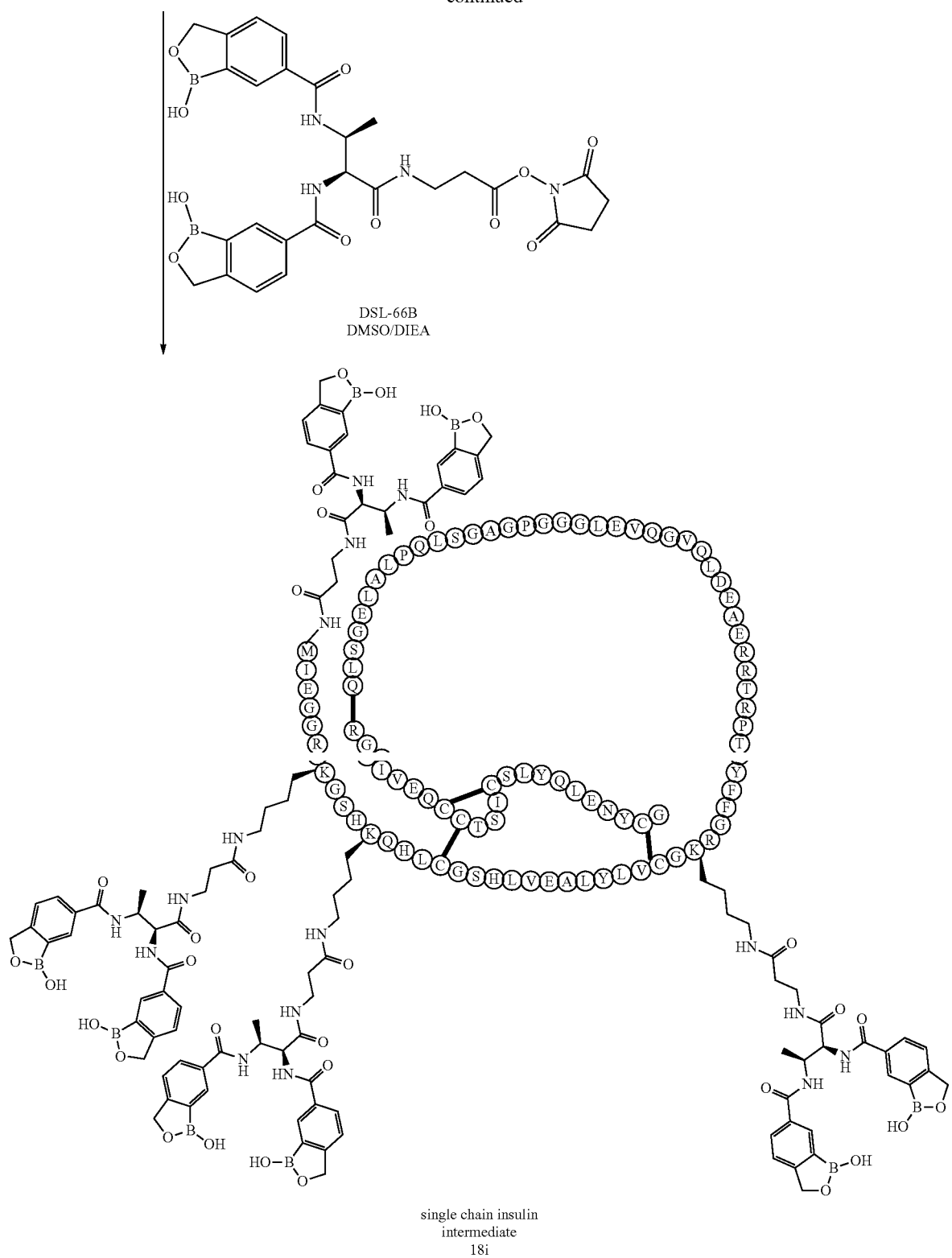
DSL-66B
DMSO/DIEA
single chain insulin
intermediate
18i
1) 50 mM acetic acid (pH 4.5)
2) 100 mM NaCl and 30% ACN
3) 1M Tris, pH 9
4) 500 mM CaCl₂
5) Trypsin

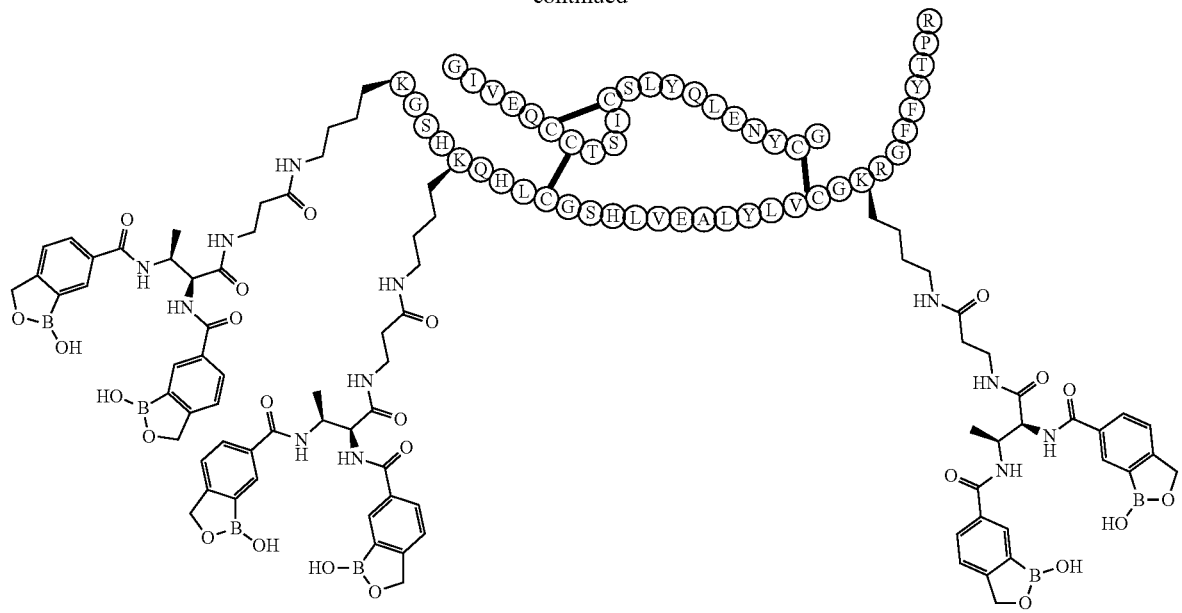

Example 66

The MS data for Example 69 is listed in Table D. The other examples listed in Table D below were synthesized under similar conditions.

TABLE D

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 69 | 7323.25 | 1454.85 | 1454.8797 | 1212.54 | 1212.5711 |

Insulin Expression and Conjugation Method 5

5a. Expression of Proinsulin

Proinsulin can be expressed using standard IPTG induction of IPTG inducible expression constructs and vectors in *E. coli* strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

5b. Conjugation of Diboronate Sensor DSL-58B with Proinsulin 17.

To a solution of one-chain proinsulin 17 (20 mg) in DMSO (200 uL) was added 2,5-dioxopyrrolidin-1-yl (S)-3-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-4-(4-methoxyphenyl)butanoate (DSL-58B, 5.8 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate 17i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 153 as a white powder (11 mg).

Scheme 5. Conjugation of DSL-58B with proinsulin 17 (SEQ ID NOS 25714-25715 and 25698-25699, respectively, in order of appearance).
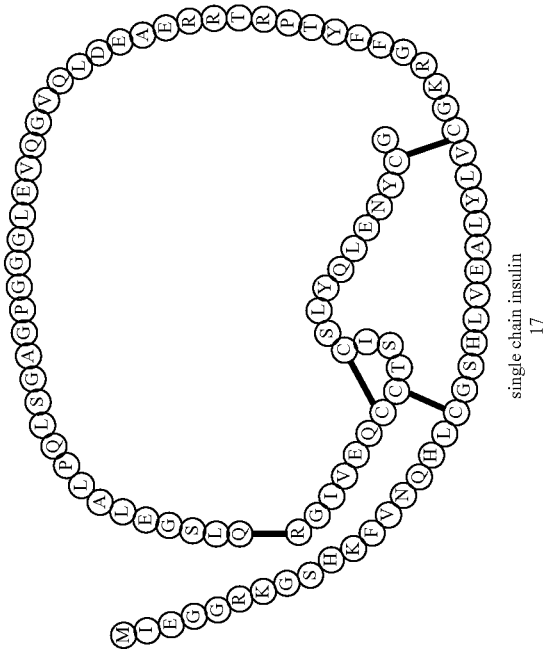
single chain insulin 17
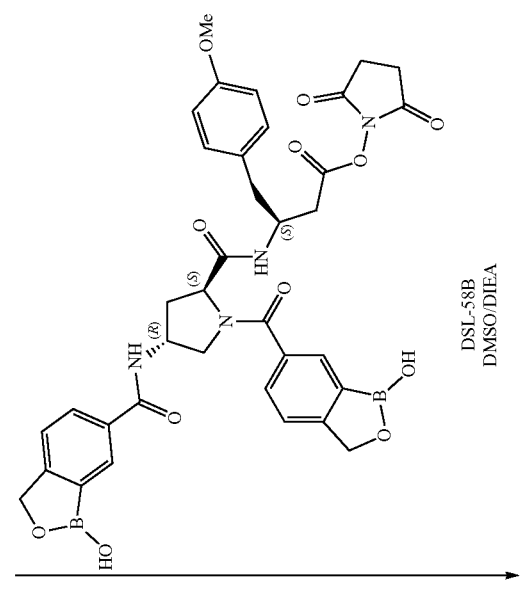
DSL-58B
DMSO/DIEA

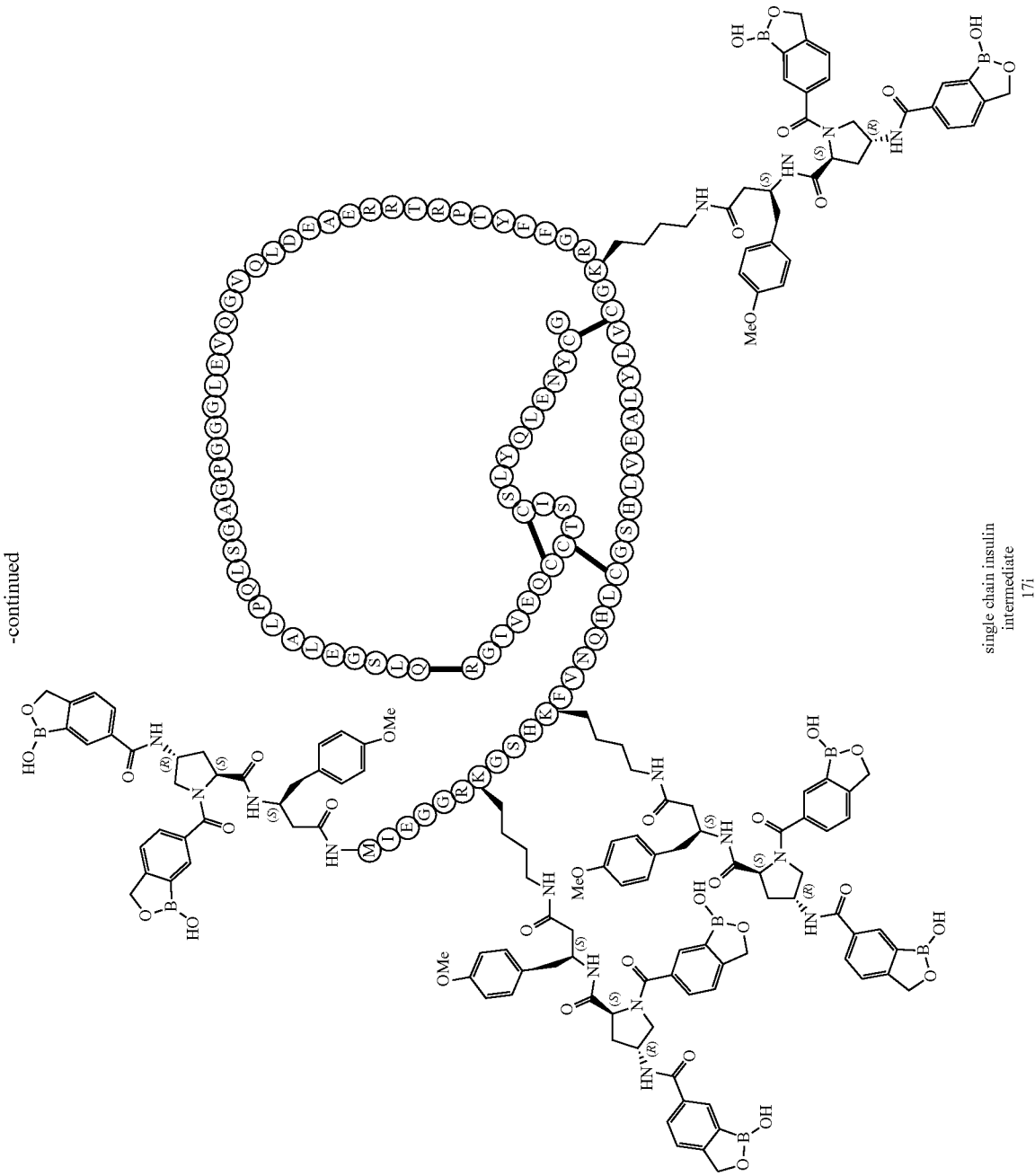
single chain insulin intermediate 17i

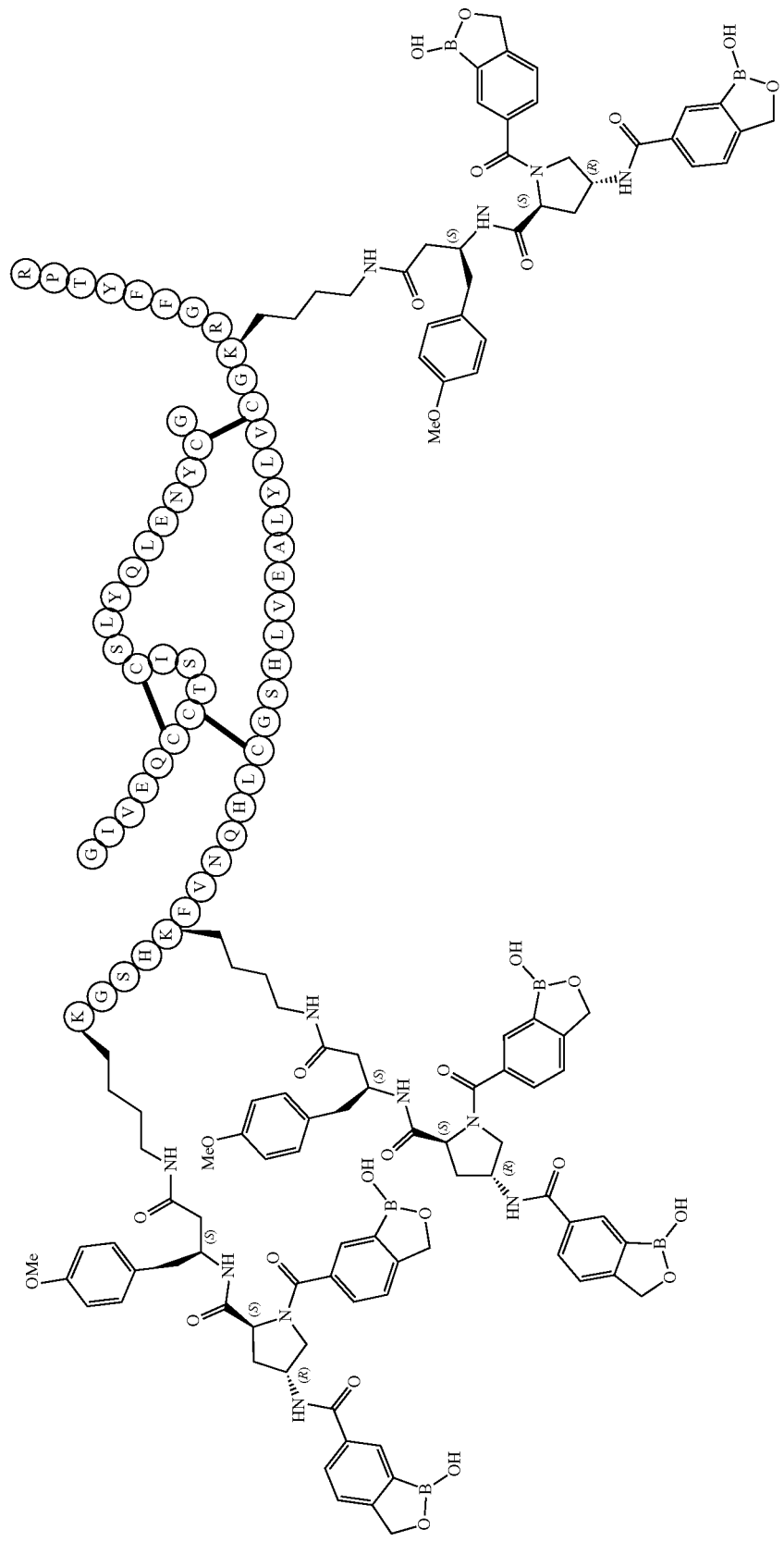
Example 153

The MS data for Example 153 is listed in Table E. The other examples listed in Table E below were synthesized under similar conditions.

TABLE E

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 8 | 7683.43 | 1526.887 | | 1272.574 | |
| Example 17 | 8151.49 | 1620.499 | | 1350.584 | |
| Example 105 | 7887.62 | 1567.725 | 1567.7978 | 1306.60 | 1306.4987 |
| Example 136 | 8043.54 | 1598.909 | 1598.9497 | 1332.593 | 1332.4593 |
| Example 138 | 7986.52 | 1587.505 | | 1323.089 | |
| Example 151 | 7845.57 | 1559.315 | 1559.3305 | 1299.598 | 1299.4420 |
| Example 153 | 8079.6 | 1606.121 | 1606.1023 | 1338.603 | 1338.6067 |

Insulin Expression and Conjugation Method 6

6a. Expression of Proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

6b. Conjugation of Diboronate Sensor DSL-69B with Proinsulin 19.

To a solution of one-chain proinsulin 19 (20 mg) in DMSO (200 uL) was added 2,5-dioxopyrrolidin-1-yl 3-((2S,3S)-2,3-bis(1-hydroxy-4-(trifluoromethyl)-1,3-dihydrobenzo[c][1,2]oxaborole-6-carboxamido)butanamido)propanoate (DSL-69B, 5 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 19i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$) (5 mM final concentration) were added. The pH was adjusted with 0.5M NaOH (5-10 uL) to ~9-9.5 then trypsin (1:500 to 1:2000 trypsin mass to insulin mass ~10 uL of 0.2 ug/mL stock solution) and carboxy peptidase (CBP, 1:1000 carboxy peptidase to insulin mass) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 131 as a white powder (8 mg).

Scheme 6. Conjugation of DSL-51B with proinsulin 19 (SEQ ID NOS 25716-25717 and 25664-25655, respectively, in order of appearance).
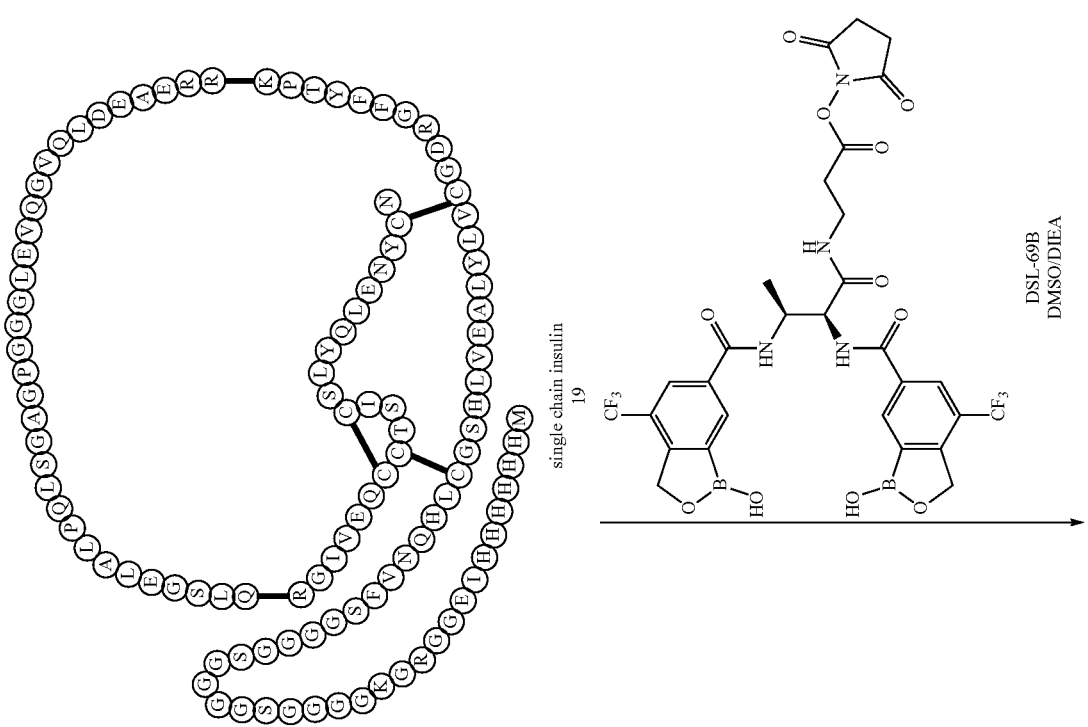

-continued
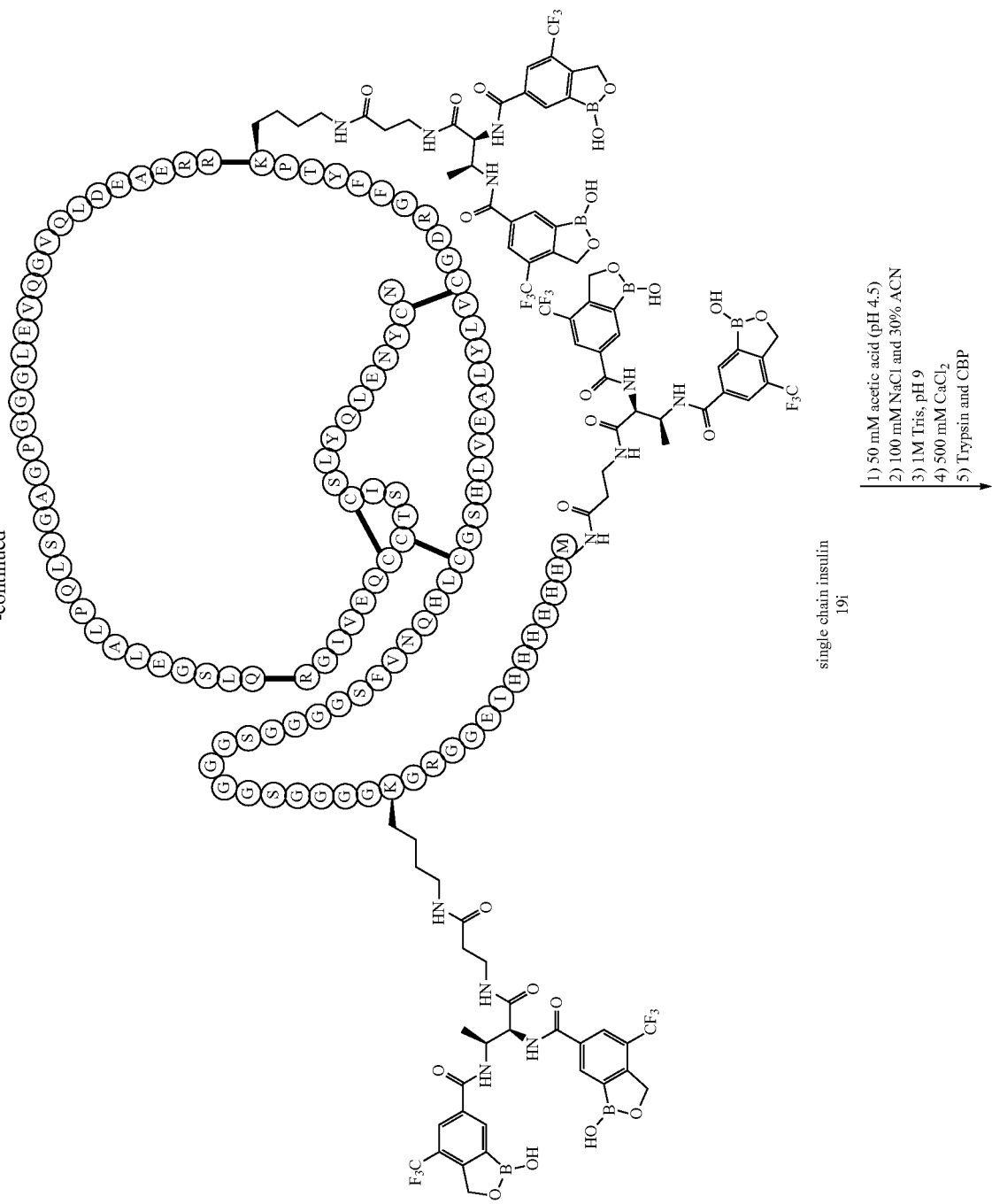
single chain insulin 19i

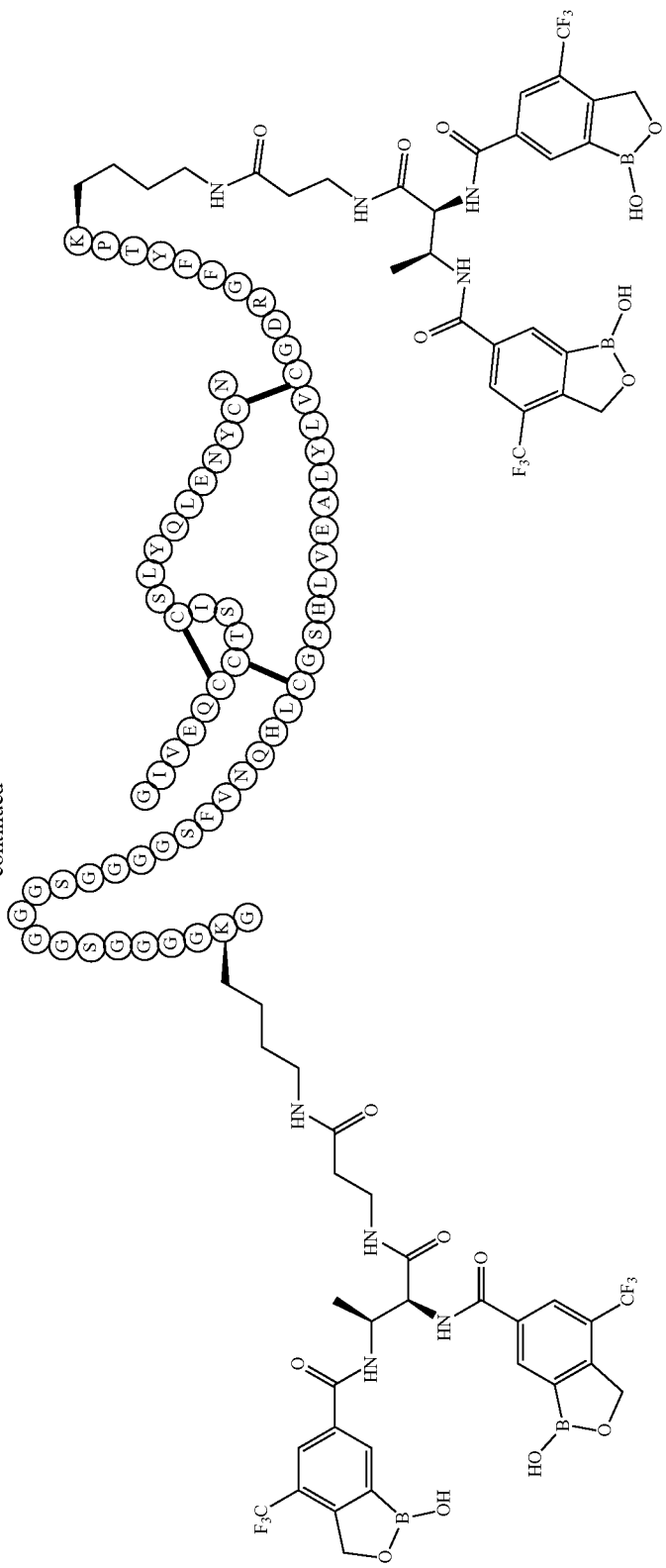
-continued
Example 131

The MS data for Example 131 is listed in Table F. The other examples listed in Table F below were synthesized under similar conditions.

TABLE F

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 2H$_2$O]$^{6+}$ | Mass Observed [M + 6H − 2H$_2$O]$^{6+}$ |
|---|---|---|---|---|---|
| Example 130 | 8089.31 | 1608.06 | | 1343.22 | |
| Example 131 | 8088.35 | 1608.063 | 1607.8112 | 1323.888 | 1342.8357 |
| Example 132 | 8032.29 | 1596.659 | | 1333.719 | |
| Example 133 | 7916.28 | 1573.457 | | 1314.384 | |
| Example 134 | 8056.29 | 1601.459 | | 1337.719 | |
| Example 135 | 8028.26 | 1595.853 | | 1333.048 | |

Insulin Expression and Conjugation Method 7

7a. Expression of Proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

7b. Conjugation of Diboronate Sensor DSL-37B with Proinsulin 20.

To a solution of one-chain proinsulin 20 (20 mg) in DMSO (200 Ul) was added 2,5-dioxopyrrolidin-1-yl (1S,2S)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)cyclohexane-1-carboxylate (DSL-37B, 7.5 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 20i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 7 as a white powder (10 mg).

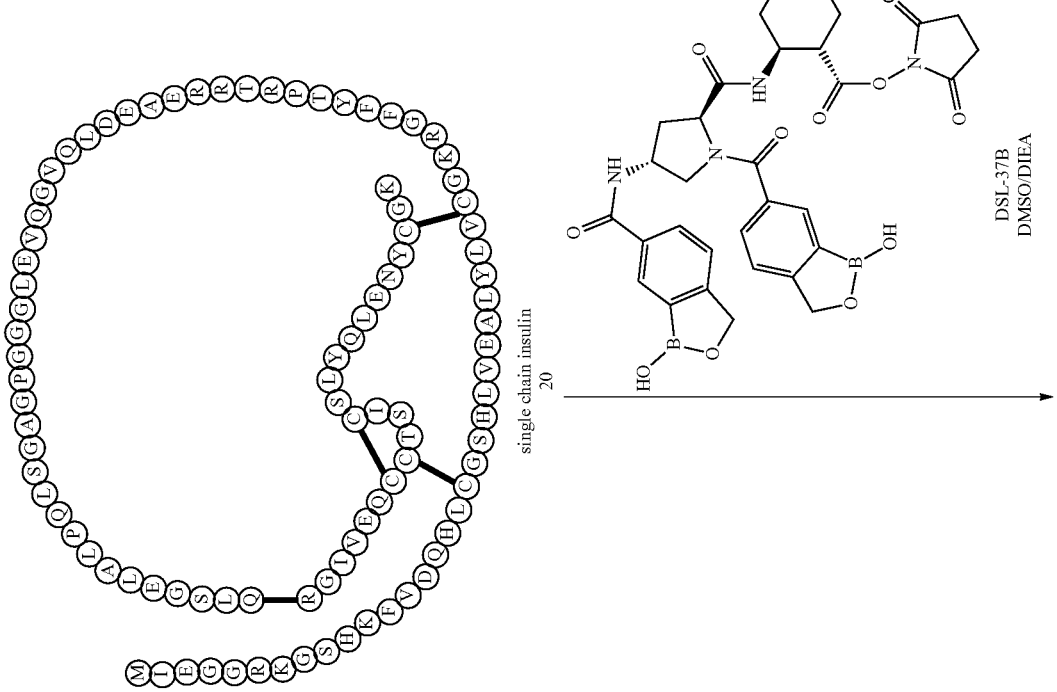
Scheme 7. Conjugation of DSL-37B with proinsulin 20 (SEQ ID NOS 25718-25719 and 25410-25411, respectively, in order of appearance).

-continued
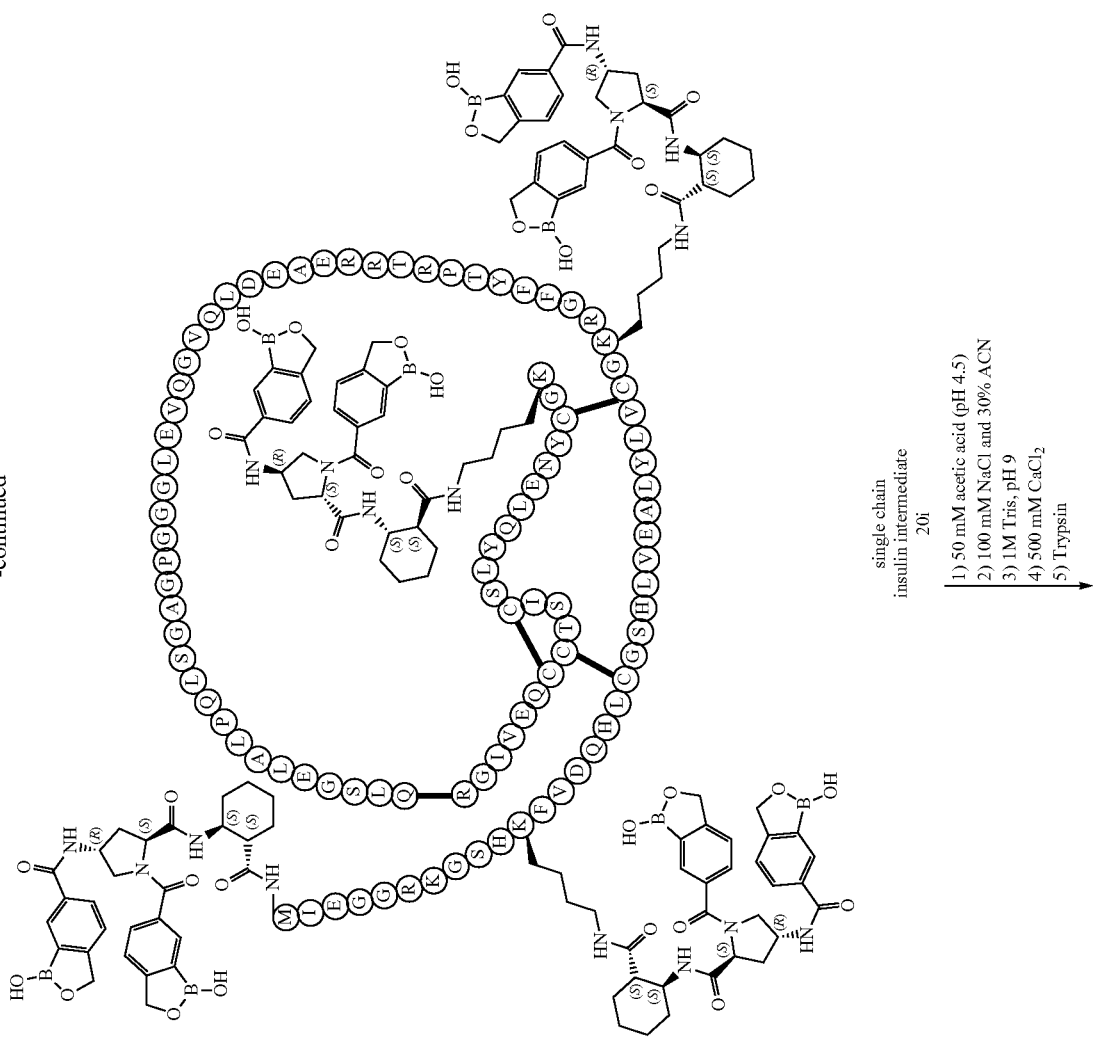

-continued
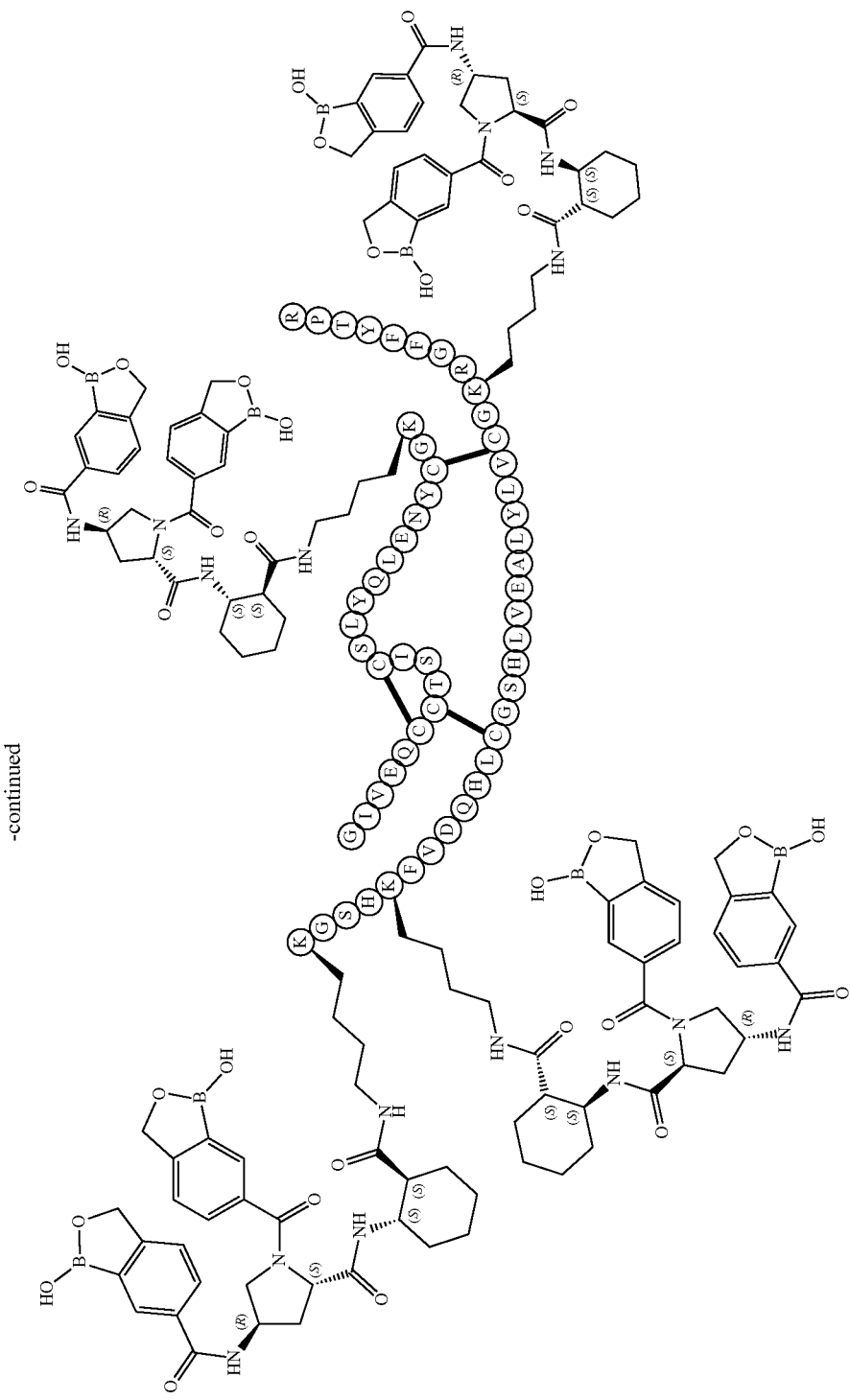
Example 7

The MS data for Example 7 is listed in Table G. The other examples listed in Table G below were synthesized under similar conditions.

TABLE G

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 3 | 8303.68 | 1650.937 | 1650.9410 | 1375.949 | 1375.7885 |
| Example 7 | 8567.86 | 1703.773 | 1703.6046 | 1422.98 | 1422.5018 |
| Example 14 | 8583.70 | 1706.941 | | 1422.619 | |
| Example 21 | 8627.91 | 1715.783 | | 1429.988 | |
| Example 88 | 8351.68 | 1660.537 | | 1383.949 | |
| Example 89 | 8495.60 | 1689.321 | | 1407.936 | |
| Example 90 | 8527.64 | 1695.729 | | 1413.276 | |
| Example 91 | 8673.56 | 1724.913 | | 1437.596 | |
| Example 92 | 8535.70 | 1697.341 | | 1414.619 | |
| Example 93 | 8727.62 | 1735.725 | | 1446.606 | |

Insulin Expression and Conjugation Method 8

8a. Expression of Proinsulin

Proinsulin can be expressed using standard IPTG induction of IPTG inducible expression constructs and vectors in *E. coli* strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

8b. Conjugation of Diboronate Sensor DSL-66B with Proinsulin 21.

To a solution of one-chain proinsulin 21 (20 mg) in DMSO (200 uL) was added 2,5-dioxopyrrolidin-1-yl 3-((2S,3S)-2,3-bis(1-hydroxy-1,3-dihydrobenzo[c][1,2]oxaborole-6-carboxamido)butanamido)propanoate (DSL-66B, 6.4 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 21i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) and carboxy peptidase (CBP, 1:1000 carboxy peptidase to insulin mass) was added was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 48 as a white powder (9 mg).

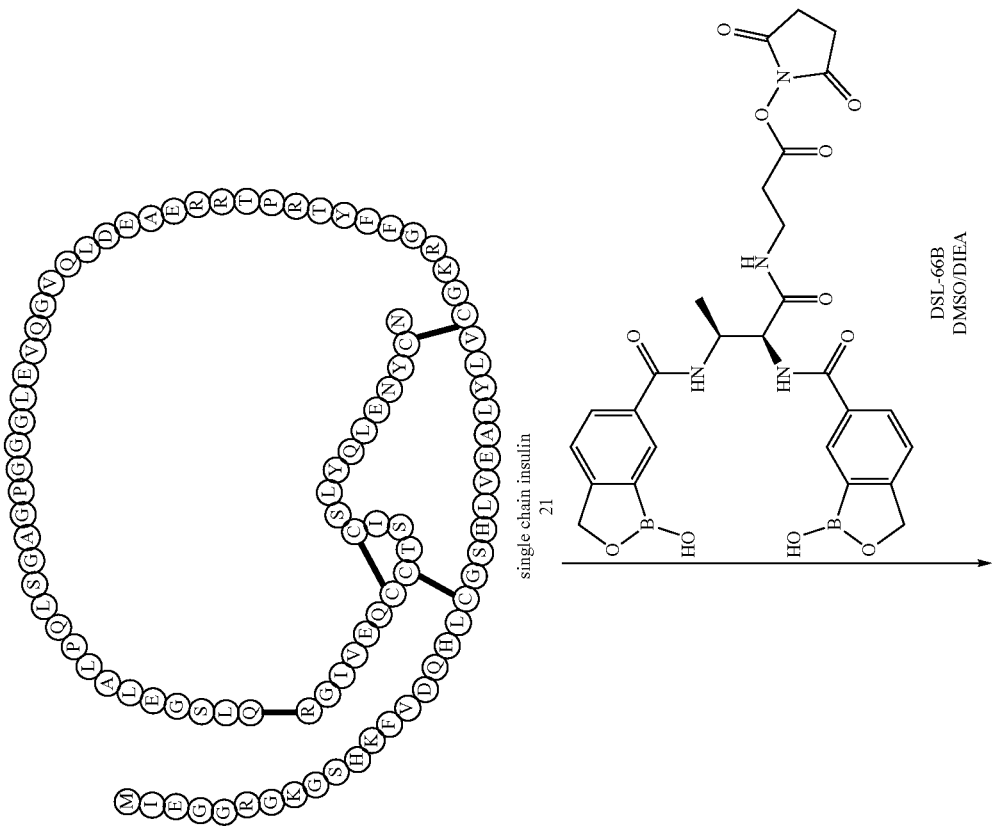

-continued
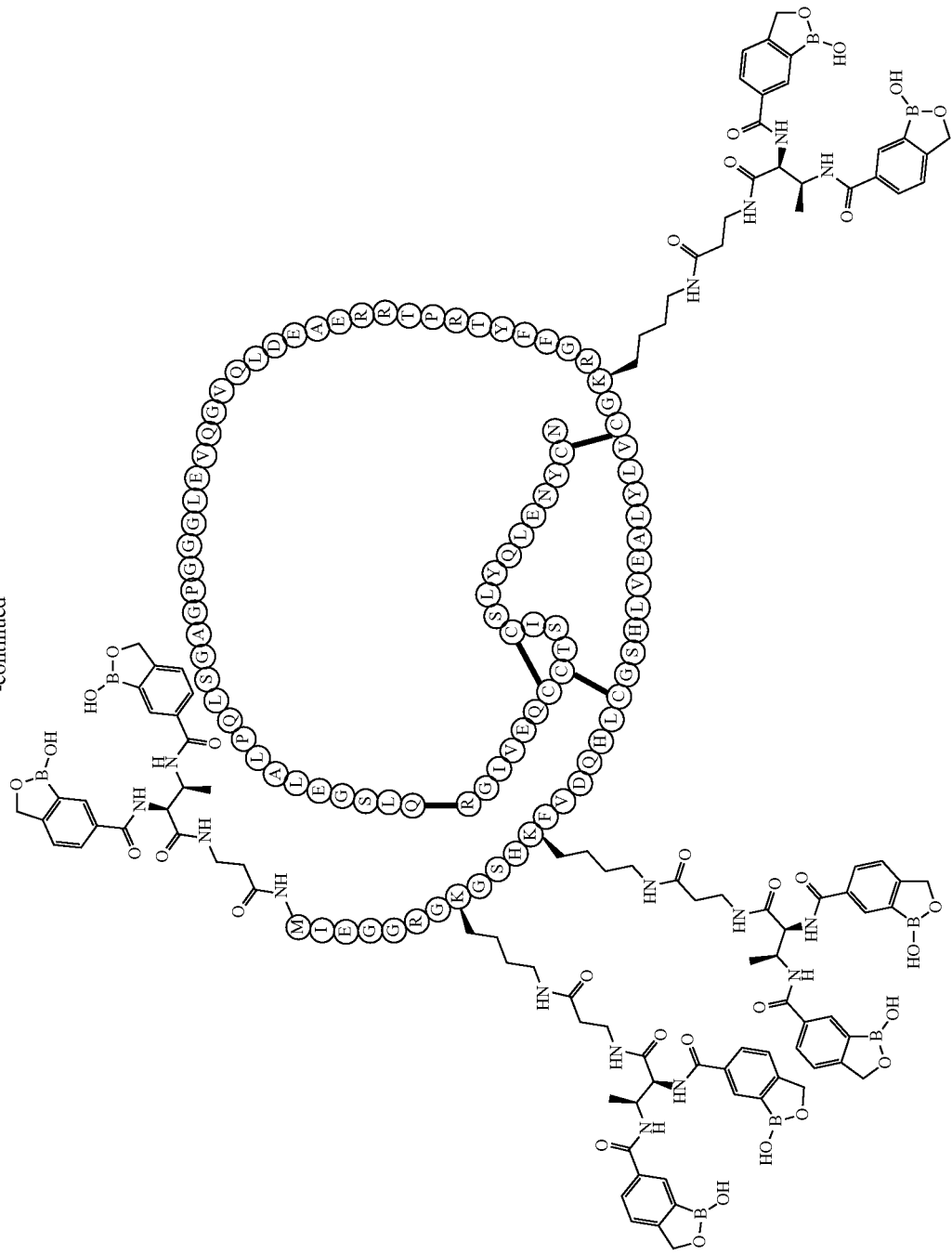
single chain insulin intermediate 21i

-continued
1) 50 mM acetic acid (pH 4.5)
2) 100 mM NaCl and 30% ACN
3) 1M Tris, pH 9
4) 500 mM CaCl₂
5) Trypsin + CBP
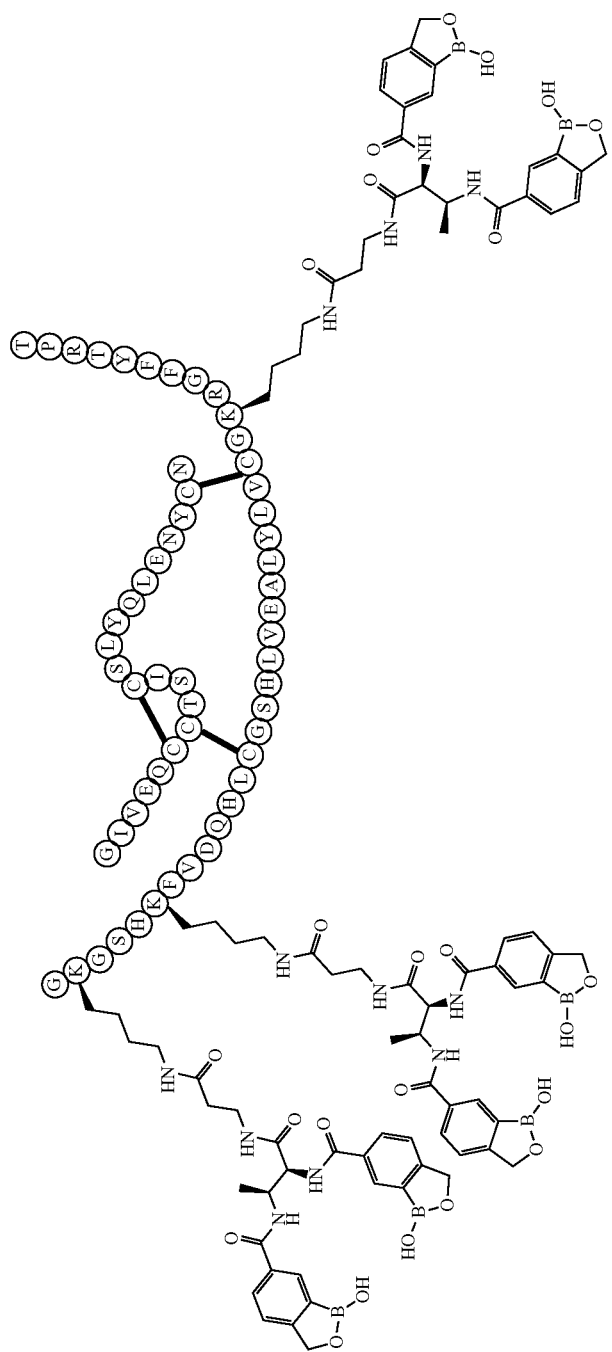
Example 48

The MS data for Example 48 is listed in Table H.

TABLE H

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 48 | 7898.52 | 1569.905 | 1569.8236 | 1308.423 | 1308.1837 |

Insulin Expression and Conjugation Method 9

9a. Expression of Proinsulin

Proinsulin can be expressed using standard IPTG induction of IPTG inducible expression constructs and vectors in *E. coli* strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

9b. Conjugation of Diboronate Sensor DSL-73B with Proinsulin 22.

To a solution of one-chain proinsulin 22 (20 mg) in DMSO (200 uL) was added 2,5-dioxopyrrolidin-1-yl (S)-3-(2,3-bis(1-hydroxy-1,3-dihydrobenzo[c][1,2]oxaborole-6-carboxamido)-2-methylpropanamido)propanoate (DSL-73B, 5.5 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 22i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) and carboxy peptidase (CBP, 1:1000 carboxy peptidase to insulin mass) was added was added. Insulin mixture was allowed to stir at r.t 16 hr.

The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 27 as a white powder (10 mg).

Scheme 9. Conjugation of DSL-73B with proinsulin 22 (SEQ ID NOS 25722-25723 and 25448-25449, respectively, in order of appearance).

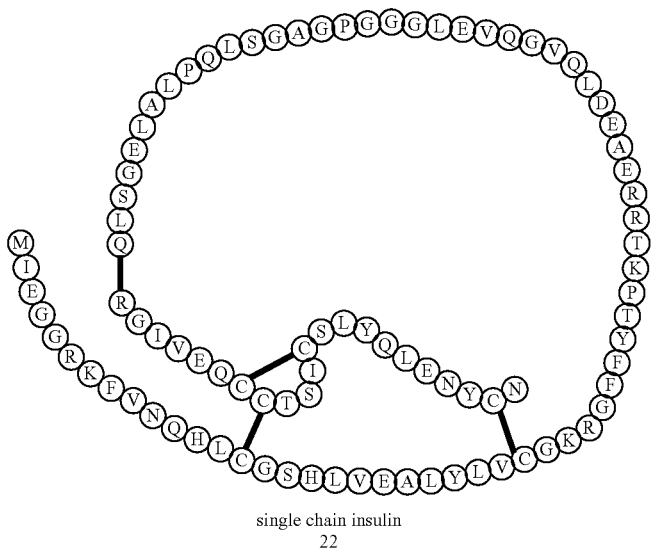

single chain insulin
22

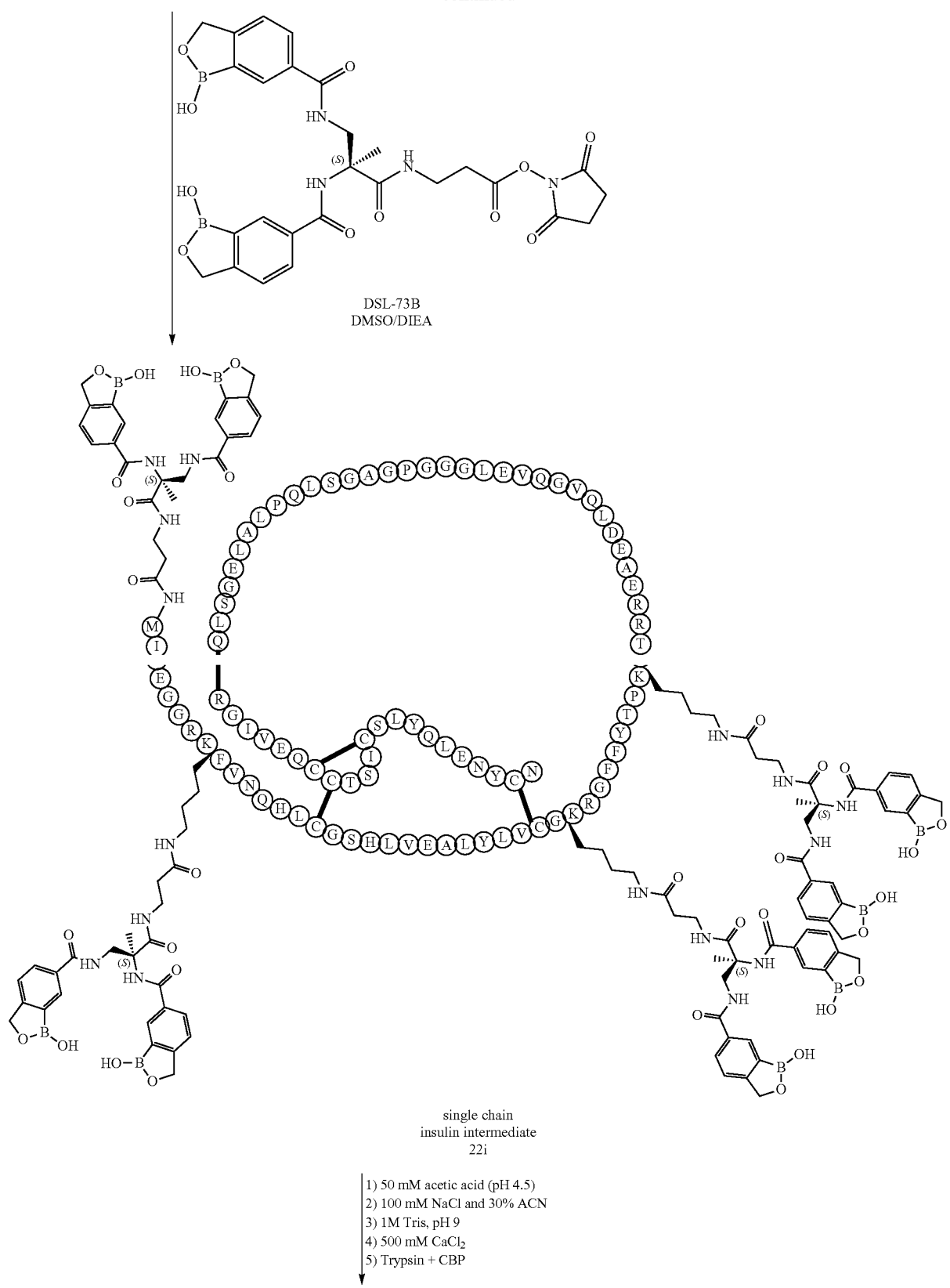

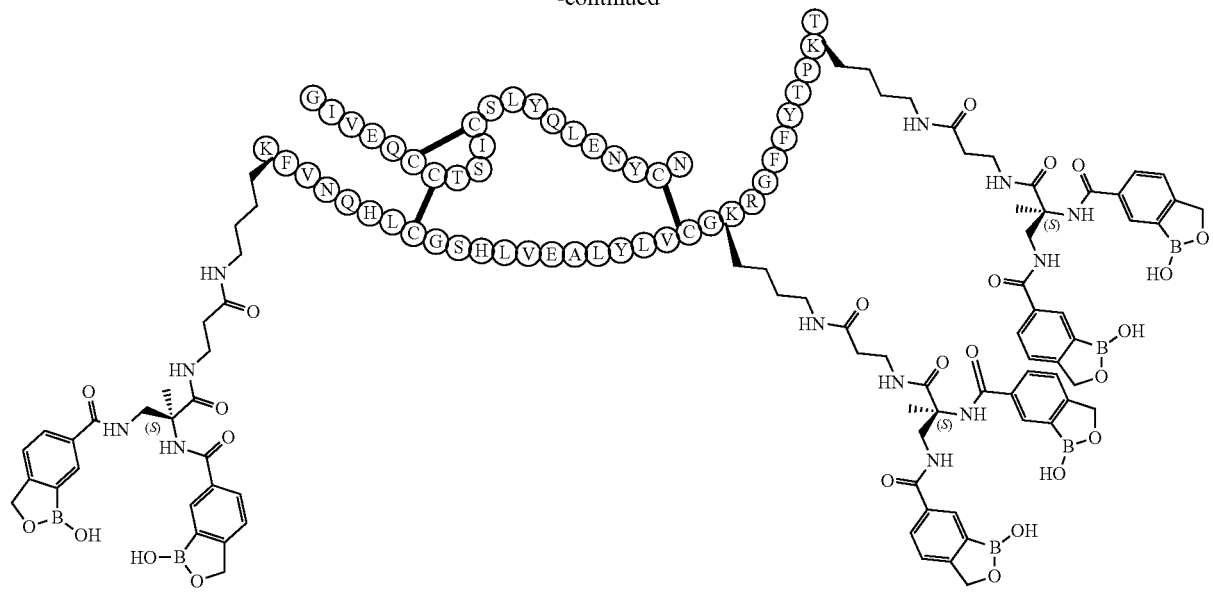

Example 27

The MS data for Example 27 is listed in Table I.

TABLE I

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 23 | 7404.29 | 1471.059 | 1470.9639 | 1226.05 | 1225.9504 |
| Example 24 | 7603.49 | 1510.899 |  | 1259.251 |  |
| Example 26 | 7530.32 | 1496.265 |  | 1247.056 |  |
| Example 27 | 7404.29 | 1471.059 | 1471.2545 | 1226.05 | 1226.2500 |
| Example 28 | 7572.26 | 1504.653 |  | 1254.046 |  |
| Example 29 | 7440.29 | 1478.259 |  | 1232.051 |  |
| Example 30 | 7512.23 | 1492.647 |  | 1244.041 |  |
| Example 32 | 7614.30 | 1513.061 |  | 1261.053 |  |
| Example 33 | 7536.37 | 1497.475 |  | 1248.064 |  |
| Example 34 | 7812.21 | 1552.643 |  | 1294.038 |  |

Insulin Expression and Conjugation Method 10

10a. Expression of Proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO: 25730) can be used for expression of the proinsulin. Proinsulin is expressed in inclusion bodies (IBs), IBs are captured, washed and further purified, for example via an existing his-tag before sensor conjugation. Expression of the desired one chain proinsulin can be performed via known procedures in the art. See, e.g., U.S. Pat. Nos. 5,457,066, 5,700,662, 5,514,646, 9,050,371, and 10,400,021.

10b. Conjugation of Diboronate Sensor DSL-66B with Proinsulin 22.

To a solution of one-chain proinsulin 22 (20 mg) in DMSO (200 uL) was added 2,5-dioxopyrrolidin-1-yl 3-((2S,3S)-2,3-bis(1-hydroxy-1,3-dihydrobenzo[c][1,2]oxaborole-6-carboxamido)butanamido)propanoate (DSL-66B, 4.5 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate proinsulin conjugate intermediate 22i. Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Insulin mixture was allowed to stir at r.t 16 hr. The crude conjugated insulin was precipitated with TFA (~200 uL) and the solution was centrifuged, decanted, and the precipitate was dissolved in DMSO (100-200 uL) then diluted into 20% ACN/Water (5-10 mL) and purified by reverse-phase HPLC. Fractions were collected, frozen, and lyophilized to yield Example 156 as a white powder (6 mg).

Scheme 10. Conjugation of DSL-66B with proinsulin 22 (SEQ ID NOS 25724-25725 and 25704-25705, respectively, in order of appearance).
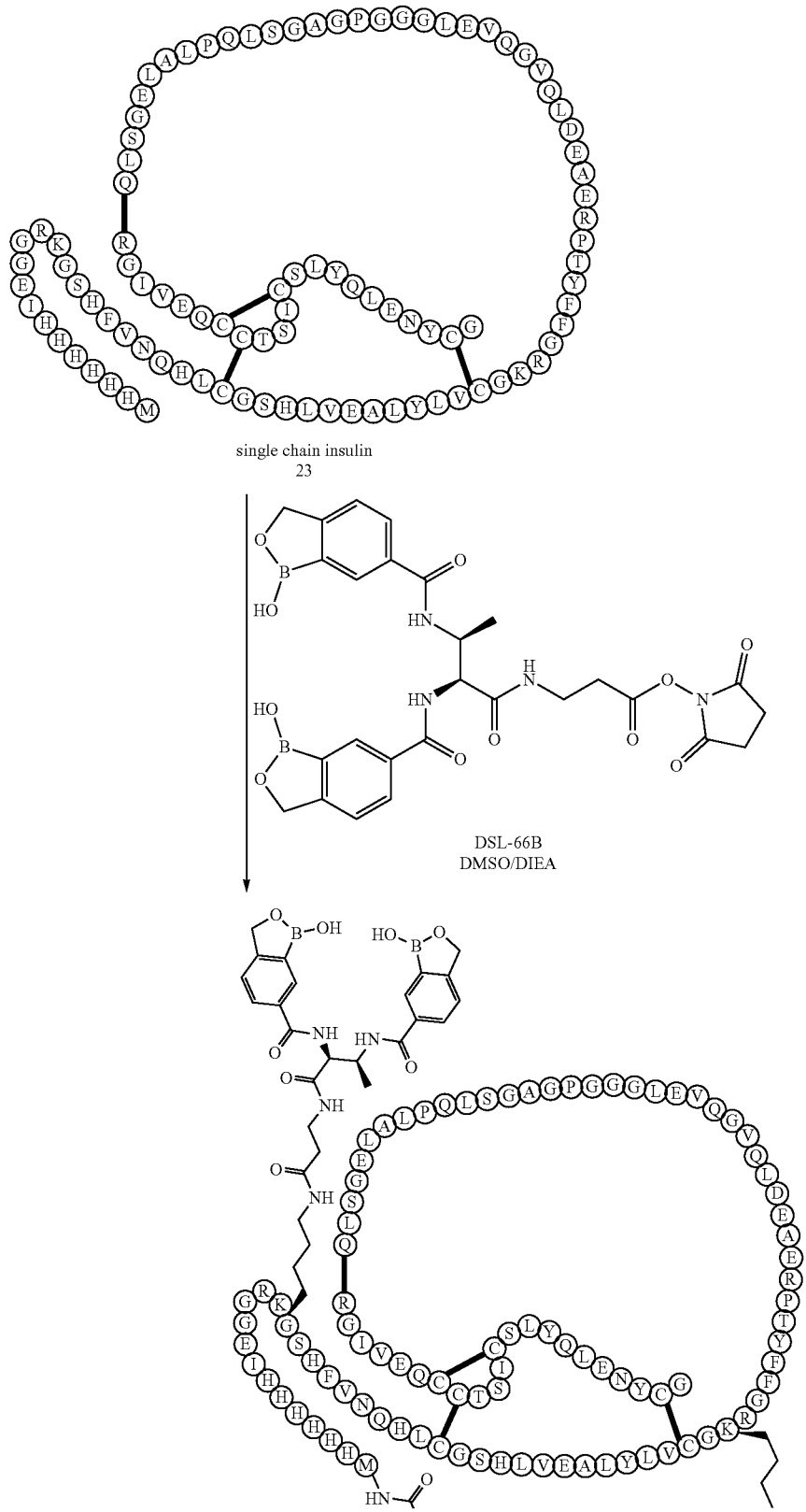

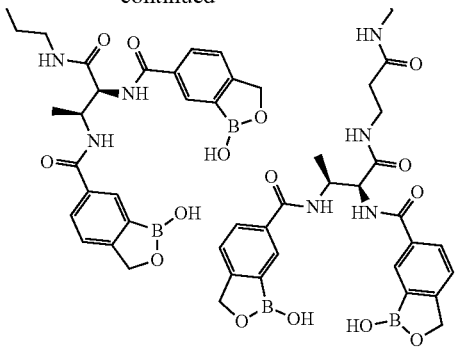
single chain insulin
23i
1) 50 mM acetic acid (pH 4.5)
2) 100 mM NaCl and 30% ACN
3) 1M Tris, pH 9
4) 500 mM CaCl$_2$
5) Trypsin
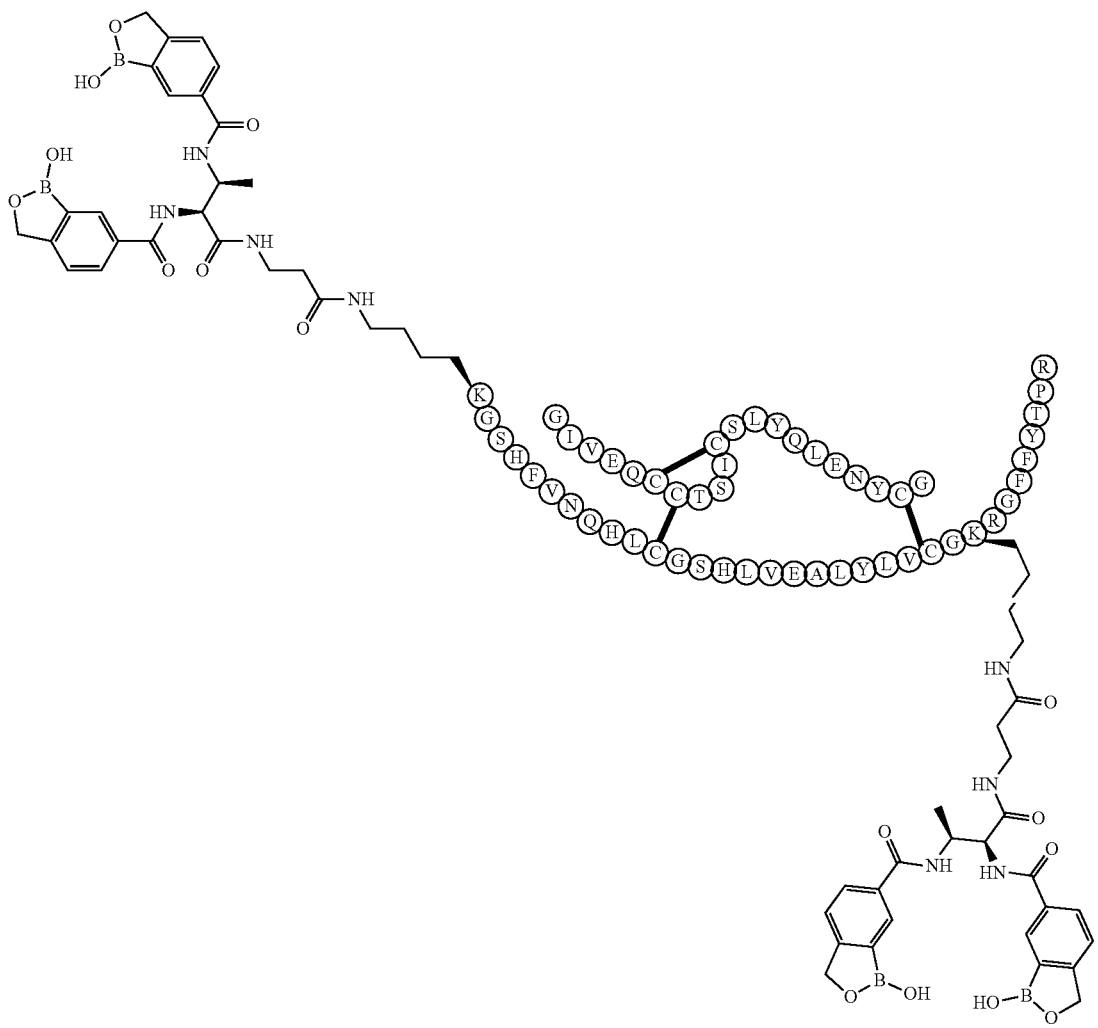
Example 156

The MS data for Example 156 is listed in Table J.

TABLE J

| Example | Mass Expected (whole mass) | Mass Calculated [M + 5H − 3H$_2$O]$^{5+}$ | Mass Observed [M + 5H − 3H$_2$O]$^{5+}$ | Mass Calculated [M + 6H − 3H$_2$O]$^{6+}$ | Mass Observed [M + 6H − 3H$_2$O]$^{6+}$ |
|---|---|---|---|---|---|
| Example 156 | 7064.17 | 1403.03 | 1403.0438 | 1169.36 | 1169.3714 |

B. Testing of Compounds for Activity in Biological Assays

Exemplary compounds (e.g. diboronated sensors) of the present disclosure were tested using an alizarin red S (ARS) displacement assay.

B.1 Procedure for Determination of the Glucose, Fructose, and Lactate Binding (Kd) Using ARS Displacement Assay The association constant for the binding event between Alizarin Red S (ARS) and the exemplary compounds tested was determined using standard methods in the art. Triplicate titrations of 10$^{−5}$ M ARS in 0.1 M phosphate buffer, pH 7.4, were performed in a 96-well plate against serial dilutions of example compounds, ranging in concentration from 0-0.1M at 25° C. The example compound-ARS solution was incubated for 5-45 minutes at 25° C., and fluorescence intensity was measured using excitation wavelength 468 nm and emission wavelength 585 nm. Changes in intensity were plotted against the concentration of the example compound, and the intensity data was fitted to yield an association constant for ARS binding.

The association constant for the binding between a target sugar compound (e.g., glucose) and the tested aromatic boron-containing groups (DSL compounds) was determined via the displacement of ARS bound to the example compounds. Triplicate wells of 10$^{−5}$ M ARS and 0.1 M example compounds in 0.1 M phosphate buffer, pH 7.4, was titrated in a 96-well plate against serial dilutions of the target sugar compound, ranging in concentration from 0-2.0 M at 25° C. The boron-ARS-carbohydrate solution was incubated for 30-60 minutes at 25° C. and the intensity of each well was measured in a plate reader at excitation wavelength 468 nm and emission wavelength 585 nm.

Changes in intensity were plotted against concentration of the target sugar compound, and the data was fitted to a one-site competition equation:

$$y = \min(y) + (\max(y) - \min(y))/(1+10^{x-\log EC50})$$

to yield an association constant for the boron compound-target sugar compound binding event.

The binding constants of DSL compounds, such as DSL-1A to DSL-112A, to glucose, fructose, and/or lactate can be tested and calculated. Exemplary DSL compounds disclosed herein have binding affinity to glucose with a Kd value ranging from about 0.01 mM to about 3 mM. Some exemplary DSL compounds disclosed herein have binding affinity to glucose with a Kd value ranging from about 0.01 mM to about 2.5 mM. Some exemplary DSL compounds disclosed herein have binding affinity to glucose with a Kd value ranging from about 0.5 mM to about 1.5 mM.

B.2 In Vitro Demonstration of Activity for Compounds of Formula I

Chinese hamster ovary (CHO) cells constitutively expressing Human Insulin Receptor Isoform B were seeded in a 96-well tissue culture microplate at 35,000 cells/well and grown overnight in Roswell Park Memorial Institute (RPMI) 1640 media supplemented with Glutamine and 10% Fetal Bovine Serum (growth media). The next morning, growth media was replaced with fresh growth media.

A separate microplate of spiking media was prepared with a stepwise serial dilution of compounds of Formula I in Dulbecco's Modified Eagle Medium (DMEM) media (without glucose, without phenol red, with 4% w/v serum albumin). Wells of serially diluted compounds of Formula I were prepared in triplicate with an appropriate "high" (e.g., 20 mM) and "low" (e.g., 3 mM) concentration of glucose to determine change in potency of compounds of Formula I at various potential blood glucose levels. Wild type insulin served as a positive control and media without any compounds served as a negative control.

Growth media on cells in the 96-well tissue culture microplate was then replaced with DMEM media (without glucose, without phenol red) and the plate was allowed to sit for 5 minutes at 37° C. The media was aspirated and replaced with the contents of the separate prepared plate (spiking media) for 10 minutes at 37° C. After 10 minutes, the spiking media was aspirated and the cells were fixed with 10% neutral buffered formalin for 10 minutes at room temperature. The neutral buffered formalin was then aspirated, and the microplate was stringently washed with PBS, pH 7.4. The microplate was then permeabilized and blocked with PBS, pH 7.4 supplemented with 10% v/v Fetal Bovine Serum and 0.1% Triton X-100 for 30 minutes. The plate was then stained at 4° C. overnight with 5% FBS in PBS+1:680 ratio (v:v) of Rabbit (Rb) α-phospho-Y1150/Y1151 IR antibody (Cell Signaling Technologies #3024). After overnight incubation followed by stringent washes with PBS, pH 7.4, the microplate was incubated at 37° C. in 5% FBS in PBS+1:1000 ratio (v/v) of HRP α-Rabbit antibody (Cell Signaling Technologies, #7074) for 100 minutes. The plate was stringently washed with PBS, pH 7.4, and colorimetric readout was developed for 15 minutes at 37° C. using TMB substrate. Color development was stopped with the addition of 0.1 M hydrochloric acid and absorbance measured at 450 nm. Triplicate absorbance values were plotted in GraphPad Prism and analyzed using a four-parameter logistic regression to generate dose-response curves. The EC50 of the dose-response curves were compared to assess fold activation of the exemplary compounds of Formula I from low to high glucose concentration. The ratio of EC50 values for GSI at high and low glucose concentrations were taken to calculate fold-change in insulin activity. The EC50 was calculated using the following equation:

$$Y = \text{Bottom} + (X\text{Hillslope}) * (\text{Top} - \text{Bottom}) / (X\text{HillSlope} + EC50\text{HillSlope}).$$

Examples 1-156 have an insulin receptor phosphorylation (JR Phosphorylation) (fold change) ranging from ≥1.2 to 45. Some examples disclosed herein had an insulin receptor phosphorylation (JR Phosphorylation) (fold change) ranging from ≥1.2 to 10.

B.3 In Vivo Demonstration of Activity for Compounds of Formula I

Male Sprague-Dawley rats underwent surgical cannulation of a carotid artery and jugular vein for blood sampling and infusions and were allowed to recover for one week. Cannulated rats were treated with streptozotocin (STZ, 55 mg/kg, 7 days) to induce a diabetic state (blood glucose concentration>300 mg/dL). Diabetic rats were fasted overnight, then placed in a solo experimental chamber and connected to sampling/infusion lines. Prior to injection of insulin examples, glucose was infused to raise the blood glucose level (BG) or phloridzin is used to lower the BG of each rat to achieve a cohort of rats in a hyperglycemic state (200 or 400 mg/dL, N=6-8) or euglycemic state (100 mg/dL, N=6-8). Blood glucose and the glucose infusion rate (GIR) required to maintain clamped BG were measured every 5 minutes and the GIR was adjusted to maintain the desired BG level. Somatostatin (5 ug/kg/min) was continuously infused throughout the study beginning with the administration of phloridzin or glucose. At time 0 min, a bolus dose (1 nmol/kg to 60 nmol/kg) of a compound of Formula I was infused over a 10 second period, and glucose was continuously infused at variable rates to maintain the hyperglycemia (200 or 400 mg/dL) or euglycemia steady state (100 mg/dL) for 300 minutes. The total area-under-the-curve (AUC) value of total glucose infusion post-compound injection until the GIR returned to its pre-compound injection value or 300 minutes was achieved was calculated for both hyperglycemic (200 or 400 mg/dL) and euglycemic (100 mg/dL) levels. Area under the curve (AUC) was calculated using the trapezoid rule and with baseline correction applied. Averaged GIR values from 30 minutes prior to injections to the injections were subtracted from each GIR value from time 0 to time 600 min for baseline correction. The trapezoidal calculation is as follows:

$$\int_a^b f(x)dx \approx (b-a) \cdot \frac{1}{2}(f(a) + f(b)).$$

Where a is the first time point (0 min) and b is the last time point (300 min). The area was calculated as a subdivision of small trapezoids as follows:

$$\int_a^b f(x)dx \approx \frac{\Delta x}{2}(f(x_0) + 2f(x_1) + 2f(x_2) + 2f(x_3) + 2f(x_4) + \ldots + 2f(x_{N-1}) + f(x_N)).$$

Such that $\Delta x$ is the difference between each time point.

Compounds of Formula I require greater GIR and total glucose infusion AUC to maintain clamped hyperglycemic BG than euglycemic BG, demonstrating a glucose-responsive increase in compound glucose-lowering action at increased BG. Compounds exhibited AUC values ranging from 250 to-5000 under hyperglycemic conditions and 200-to-4500 under euglycemic levels. The ratio of hyperglycemic AUC to euglycemic AUC ranged from 0.01-to-5 in 400 mg/dL to 100 mg/dL and ranged from 0.2-to-4.5 in 200 mg/dL to 100 mg/dL.

It is also observed in cell-based experiments on compounds containing formulae FF116, FF116A-D, FF225, FF225A, FF225B, and FF226 that sensors with geminal alkyl substituent on the same carbon as the nitrogen conjugated to the boroxole or boronates provided between 5-56% higher glucose responsiveness in the range of 3-20 mM glucose in comparison to variants that do not have the geminal alkyl substituents. For example, when a Z1C represented by one of formulae FF12, FF12A-D, FF116, FF116A-D, FF225, FF225A, FF225B, and FF226 is conjugated to lysine residues in insulin wherein the boronates (B1, B2) in formulae FF12, FF12A-D, FF116, FF116A-D, FF225, FF225A, FF225B, and FF226 are represented by F2, the resulting insulin is observed to be between 11-56% more responsive to changes in glucose levels between 3-20 mM glucose than if instead of one of the formulae FF12, FF12A-D, FF116, FF116A-D, FF225, FF225A, FF225B, and FF226, one uses 2,3-diaminopropionic acid. This data shows that the presence of the geminal alkyl substituent on the same carbon as the nitrogen conjugated to the boroxole or boronates improves glucose responsiveness of the resulting insulin conjugate, and in tested variations in the 3-20 mM glucose range.

Without wishing to be bound by theory, it is believed that this general principle extends to other formulae FF12, FF12A-D, FF114, FF115, FF116, FF116A-D, FF117, FF193A, FF203, FF225, FF225A, FF225B, and FF226 providing a framework for enhancement of glucose responsiveness by at least 5%, at least 10%, at least 20%, or at least 40% in the 3-20 mM or 2-50 mM glucose ranges.

Without wishing to be bound by theory, it is believed based on observations of glucose responsiveness trends, that the presence of the carbonyl group adjacent to- or within less than two carbon centers away from the amine groups in FF formulae (to which aromatic boron-containing groups are conjugated) enhances glucose responsiveness through impacting ability to turn off activity of drug substance through plasma protein interactions such as with albumin and that this is independent of glucose affinity such that glucose affinity is not impacted by the position of this carbonyl group.

Without wishing to be bound by theory, it is believed that the pharmacokinetics of the molecules and potential albumin or blood proteins binding is impacted by the position of this carbonyl group, and thereby enhances overall glucose responsiveness whilst the absolute glucose affinity is maintained or nearly identical. Therefore, in certain embodiments of the present invention, the carbonyl group (as part of an acid, amid or linkage to X in FF formulae) is placed within less than three, or within less than two-carbon centers away from one of the two amines to which the boron-containing compounds are conjugated. In certain embodiments, the placement of amines within two carbon centers from each other enables the spatial and geometric constraining of the aromatic boron containing groups to enhance glucose binding and selectively, and furthermore the presence of a carbonyl group (for example, as part of an amide linkage) which is within less than two carbon centers, from one of the two amines (to which aromatic boron containing groups are attached) ensures differential albumin binding in a manner that results in the compound exhibiting glucose responsiveness in the blood and in the body. In some embodiments, the combination of geometrical constraining of the two amines to which the aromatic boron containing groups are conjugated, as well as the presence of the carbonyl within one to two carbon centers from one of the amines provides the necessary requirements for glucose responsiveness in physiological blood and plasma glucose levels.

Without wishing to be bound by theory, it is believed based on observations of glucose responsiveness trends, that the interaction of the indirect linker with the Z1c helps further enhance glucose responsiveness. For example, enhanced glucose responsiveness may result in some embodiments where Z1c is selected from FF12, FF12A-D, FF116, FF116A-D, B1 and B2 are represented by F2, wherein each of the remaining R1 is H, and wherein the indirect linker is selected from a relatively hydrophobic amino acid or contains a relatively hydrophobic molecule (e.g., linker) selected from FL3, FL20-22, FL25, FL27-28, FL30-33, FL35, FL37, FL41, FL43, FL45-70. For example, enhanced glucose responsiveness may result in some embodiments where Z1c is selected from FF12, FF12A-D, FF116, FF116A-D, B1 and B2 are represented by F2 wherein one of the remaining R1 is $CF_3$ and the remaining R1 is H, and wherein the indirect linker is selected from a hydrophilic amino acid or contains a hydrophilic molecule (e.g., linker) selected from FL5, FL5A, FL5B, FL23-24, FL26, FL29, FL34, FL36, FL38-40, and FL42.

Without wishing to be bound by theory, in some embodiments glucose responsiveness at physiological ranges of 3-10 mM, 4-10 mM, 3-20 mM or 4-20 mM glucose is further enhanced either by (i) a combination of a relatively hydrophobic indirect linker (e.g., FL3, FL20-22, FL25, FL27-28, FL30-33, FL35, FL37, FL41, FL43-70) and a Z1c in which both B1 and B2 are selected from F2, wherein all remaining R1 are H, or (ii) a combination of a relatively hydrophilic indirect linker (e.g., FL5, FL5A, FL5B, FL23-24, FL26, FL29, FL34, FL36, FL38-40, FL42) and a Z1c in which both B1 and B2 are selected from F2, wherein one of the remaining R1 is CF3.

Without wishing to be bound by theory, in some embodiments glucose responsiveness of an insulin at physiological ranges of 3-10 mM, 4-10 mM, 3-20 mM or 4-20 mM glucose is further enhanced either by (i) a combination of a relatively hydrophobic indirect linker and a Z1c in which both B1 and B2 are selected from F2, wherein all remaining R1 are H, wherein at least three or at least four lysine residues in the insulin are conjugated to a Z1c or (ii) a combination of a relatively hydrophilic indirect linker and a Z1c in which both B1 and B2 are selected from F2, wherein one of the remaining R1 is CF3, and wherein at least two or at least three lysine residues in the insulin are conjugated to a Z1c.

Without wishing to be bound by theory, in some embodiments glucose responsiveness is enhanced through selection of combination of the indirect linker and Z1c is selected from (i) a combination of a relatively hydrophobic indirect linker and a Z1c in which both B1 and B2 are selected from F2, wherein all remaining R1 are H, or (ii) a combination of a relatively hydrophilic indirect linker and a Z1c in which both B1 and B2 are selected from F2, wherein one of the remaining R1 is CF3 and the remaining R1 is H.

Without wishing to be bound by theory, in some embodiments glucose responsiveness is enhanced through selection of combination of the indirect linker and Z1c is selected from (i) a combination of a relatively hydrophobic indirect linker and a Z1C selected from FF12, FF12A-D, FF116, FF116A-D, in which both B1 and B2 are selected from F2, wherein all remaining R1 are H, or (ii) a combination of a relatively hydrophilic indirect linker and a Z1c selected from FF12, FF12A-D, FF116, FF116A-D, in which both B1 and B2 are selected from F2, wherein one of the remaining $R_1$ is $CF_3$ and the remaining R1 is H.

Experiments on cell-based assays of insulins with lysine residues conjugated with one of formulae FF12, FF12A-D, FF114, FF115, FF116, FF116A-D, FF117, FF193A, FF203, FF225, FF225A, FF225B, and FF226 demonstrated that the enhanced glucose responsiveness of the insulins is increased when one or more lysine residues are modified as described by Formula I using one of formulae FF12, FF12A-D, FF114, FF115, FF116, FF116A-D, FF117, FF193A, FF203, FF225, FF225A, FF225B, and FF226, and wherein the lysine residues are present in insulin (as insertions or mutations) or in a polypeptide that is appended to the N- or C-terminus of the B-chain of insulin or the C-terminus of the A-chain of insulin, and wherein there are additional lysine residues within the insulin sequence that are similarly modified. The results are further corroborated by testing of the compounds of Formula I in STZ diabetic mouse models wherein the activity of the insulin is measured through bolus injections of the compounds of Formula I followed by glucose challenges and measurements of blood glucose, or through glucose clamp assays in which activity of the insulins is measured as a function of blood glucose levels. The results further showed that exemplary compounds of Formula I disclosed herein function in the body and are responsive to physiological changes in blood glucose and provide dynamic insulin action in the body in response to changes in blood glucose levels. In certain embodiments one or more lysine residues near the N-terminus of a polypeptide appended to the N-terminus of the B-chain of insulin, as well as at least one additional lysine in the B-chain of insulin are conjugated as described by Formula IC.

In certain embodiments, a sequence is appended to the N-terminus and/or C-terminus, and/or inserted into the sequence of the A-chain of insulin, wherein the A-chain of insulin comprises one of the following sequences, optionally with up to four additional deletions and/or mutations:

```
                                  (SEQ ID NO: 1)
GIVEQCCTSICSLYQLENYCN;

(SEQ ID NO: 25)
GIVEQCCTSICSLYQLENYCGK;

(SEQ ID NO: 24051)
GIVEQCCTSICSLYQLENYCG;

(SEQ ID NO: 24052)
GIVEQCCTSICSLEQLENYCG;
``` and/or a sequence is appended to the N-terminus and/or C-terminus, and/or inserted into the sequence of the B-chain of insulin, wherein the B-chain of insulin comprises one of following sequences, and optionally with up to four additional deletions and/or mutations:

```
                                          (SEQ ID NO: 24060)
KFVNQHLCGSHLVEALYLVCGKRGFFYTPKT;

(SEQ ID NO: 24061)
KGSHFVNQHLCGSHLVEALYLVCGKRGFFYTPR;

(SEQ ID NO: 24062)
KGSHQHLCGSHLVEALYLVCGKRGFFYTPR;

(SEQ ID NO: 24063)
KGSHKQHLCGSHLVEALYLVCGKRGFFYTPR;

(SEQ ID NO: 24064)
GKPGGGGSGGGGSGGGGSFVNQHLCGSHLVEALYLVCGDRGFFYTPK;

(SEQ ID NO: 25000)
KFVNQHLCGSHLVEALYLVCGKRGFFYTRPT;

(SEQ ID NO: 25001)
KFVGQHLCGSHLVEALYLVCGKRGFFYTRPT;

(SEQ ID NO: 25002)
KHLCGSHLVEALYLVCGKRGFFYTRPT;
```

KFVNQHLCGSHLVEALYLVCGKRGFFYTRP; (SEQ ID NO: 25003)

KFVGQHLCGSHLVEALYLVCGKRGFFYTRP; (SEQ ID NO: 25004)

KHLCGSHLVEALYLVCGKRGFFYTRP; (SEQ ID NO: 25005)

KFVSQHLCGSHLVEALYLVCGKRGFFYTPR; (SEQ ID NO: 25006)

KFVTQHLCGSHLVEALYLVCGKRGFFYTPR; (SEQ ID NO: 25007)

KFVGQHLCGSHLVEALYLVCGKRGFFYTPR; (SEQ ID NO: 25008)

KFVNQHLCGSHLVEALYLVCGKRGFFYTPR; (SEQ ID NO: 25009)

KHLCGSHLVEALYLVCGKRGFFYTPR; (SEQ ID NO: 25010)

KFVNQHLCGSHLVEALYLVCGERGFFYTKPT; (SEQ ID NO: 25011)

KFVGQHLCGSHLVEALYLVCGERGFFYTKPT; (SEQ ID NO: 25012)

KHLCGSHLVEALYLVCGERGFFYTKPT; (SEQ ID NO: 25013)

KFVNQHLCGSHLVEALYLVCGERGFFYTKP; (SEQ ID NO: 25014)

KFVGQHLCGSHLVEALYLVCGERGFFYTKP; (SEQ ID NO: 25015)

KHLCGSHLVEALYLVCGERGFFYTKP; (SEQ ID NO: 25016)

KFVSQHLCGSHLVEALYLVCGERGFFYTPK; (SEQ ID NO: 25017)

KFVTQHLCGSHLVEALYLVCGERGFFYTPK; (SEQ ID NO: 25018)

KFVGQHLCGSHLVEALYLVCGERGFFYTPK; (SEQ ID NO: 25019)

KFVNQHLCGSHLVEALYLVCGERGFFYTPK; (SEQ ID NO: 25020)

KHLCGSHLVEALYLVCGERGFFYTPK; (SEQ ID NO: 25021)

KFVNQHLCGSHLVEALYLVCGDRGFFYTKPT; (SEQ ID NO: 25022)

KFVGQHLCGSHLVEALYLVCGDRGFFYTKPT; (SEQ ID NO: 25023)

KHLCGSHLVEALYLVCGDRGFFYTKPT; (SEQ ID NO: 25024)

KFVNQHLCGSHLVEALYLVCGDRGFFYTKP; (SEQ ID NO: 25025)

KFVGQHLCGSHLVEALYLVCGDRGFFYTKP; (SEQ ID NO: 25026)

KHLCGSHLVEALYLVCGDRGFFYTKP; (SEQ ID NO: 25027)

KFVSQHLCGSHLVEALYLVCGDRGFFYTPK; (SEQ ID NO: 25028)

KFVTQHLCGSHLVEALYLVCGDRGFFYTPK; (SEQ ID NO: 25029)

KFVGQHLCGSHLVEALYLVCGDRGFFYTPK; (SEQ ID NO: 25030)

KFVNQHLCGSHLVEALYLVCGDRGFFYTPK; (SEQ ID NO: 25031)

KHLCGSHLVEALYLVCGDRGFFYTPK; (SEQ ID NO: 25032)

KFVNQHLCGSHLVEALHLVCGKRGFFYTRPT; (SEQ ID NO: 25033)

KFVGQHLCGSHLVEALHLVCGKRGFFYTRPT; (SEQ ID NO: 25034)

KHLCGSHLVEALHLVCGKRGFFYTRPT; (SEQ ID NO: 25035)

KFVNQHLCGSHLVEALHLVCGKRGFFYTRP; (SEQ ID NO: 25036)

KFVGQHLCGSHLVEALHLVCGKRGFFYTRP; (SEQ ID NO: 25037)

KHLCGSHLVEALHLVCGKRGFFYTRP; (SEQ ID NO: 25038)

KFVSQHLCGSHLVEALHLVCGKRGFFYTPR; (SEQ ID NO: 25039)

KFVTQHLCGSHLVEALHLVCGKRGFFYTPR; (SEQ ID NO: 25040)

KFVGQHLCGSHLVEALHLVCGKRGFFYTPR; (SEQ ID NO: 25041)

KFVNQHLCGSHLVEALHLVCGKRGFFYTPR; (SEQ ID NO: 25042)

KHLCGSHLVEALHLVCGKRGFFYTPR; (SEQ ID NO: 25043)

KFVGQHLCGSHLVEALHLVCGDRGFFYTKPT; (SEQ ID NO: 25044)

KHLCGSHLVEALHLVCGDRGFFYTKPT; (SEQ ID NO: 25045)

KFVNQHLCGSHLVEALHLVCGDRGFFYTKP; (SEQ ID NO: 25046)

KFVGQHLCGSHLVEALHLVCGDRGFFYTKP; (SEQ ID NO: 25047)

KHLCGSHLVEALHLVCGDRGFFYTKP; (SEQ ID NO: 25048)

KFVSQHLCGSHLVEALHLVCGDRGFFYTPK; (SEQ ID NO: 25049)

KFVTQHLCGSHLVEALHLVCGDRGFFYTPK; (SEQ ID NO: 25050)

KFVGQHLCGSHLVEALHLVCGDRGFFYTPK; (SEQ ID NO: 25051)

KFVNQHLCGSHLVEALHLVCGDRGFFYTPK; (SEQ ID NO: 25052)

KHLCGSHLVEALHLVCGDRGFFYTPK; (SEQ ID NO: 25053)

KFVNQHLCGSHLVEALHLVCGKRGFHYTRPT; (SEQ ID NO: 25054)

KFVGQHLCGSHLVEALHLVCGKRGFHYTRPT; (SEQ ID NO: 25055)

KHLCGSHLVEALHLVCGKRGFHYTRPT; (SEQ ID NO: 25056)

```
                                                      (SEQ ID NO: 25057)
KFVNQHLCGSHLVEALHLVCGKRGFHYTRP;

(SEQ ID NO: 25058)
KFVGQHLCGSHLVEALHLVCGKRGFHYTRP;

(SEQ ID NO: 25059)
KHLCGSHLVEALHLVCGKRGFHYTRP;

(SEQ ID NO: 25060)
KFVSQHLCGSHLVEALHLVCGKRGFHYTPR;

(SEQ ID NO: 25061)
KFVTQHLCGSHLVEALHLVCGKRGFHYTPR;

(SEQ ID NO: 25062)
KFVGQHLCGSHLVEALHLVCGKRGFHYTPR;

(SEQ ID NO: 25063)
KFVNQHLCGSHLVEALHLVCGKRGFHYTPR;

(SEQ ID NO: 25064)
KHLCGSHLVEALHLVCGKRGFHYTPR;

(SEQ ID NO: 25065)
KFVNQHLCGSHLVEALHLVCGDRGFHYTKPT;

(SEQ ID NO: 25066)
KFVGQHLCGSHLVEALHLVCGDRGFHYTKPT;

(SEQ ID NO: 25067)
KHLCGSHLVEALHLVCGDRGFHYTKPT;

(SEQ ID NO: 25068)
KFVNQHLCGSHLVEALHLVCGDRGFHYTKP;

(SEQ ID NO: 25069)
KFVGQHLCGSHLVEALHLVCGDRGFHYTKP;

(SEQ ID NO: 25070)
KHLCGSHLVEALHLVCGDRGFHYTKP;

(SEQ ID NO: 25071)
KFVSQHLCGSHLVEALHLVCGDRGFHYTPK;

(SEQ ID NO: 25072)
KFVTQHLCGSHLVEALHLVCGDRGFHYTPK;

(SEQ ID NO: 25073)
KFVGQHLCGSHLVEALHLVCGDRGFHYTPK;

(SEQ ID NO: 25074)
KFVNQHLCGSHLVEALHLVCGDRGFHYTPK;

(SEQ ID NO: 25075)
KHLCGSHLVEALHLVCGDRGFHYTPK;

(SEQ ID NO: 25076)
KGSHGGGGSGGGGSGGGGSFVNQHLCGSHLVEALYLVCGKRGFFYTRPT;

(SEQ ID NO: 25077)
KGSHGGGGSGGGGSGGGGSFVGQHLCGSHLVEALYLVCGKRGFFYTRPT;

(SEQ ID NO: 25078)
KGSHGGGGSGGGGSGGGGSHLCGSHLVEALYLVCGKRGFFYTRPT;

(SEQ ID NO: 25079)
KGSHGGGGSGGGGSGGGGSFVNQHLCGSHLVEALYLVCGKRGFFYTRP;

(SEQ ID NO: 25080)
KGSHGGGGSGGGGSGGGGSFVGQHLCGSHLVEALYLVCGKRGFFYTRP;

(SEQ ID NO: 25081)
KGSHGGGGSGGGGSGGGGSHLCGSHLVEALYLVCGKRGFFYTRP;

(SEQ ID NO: 25082)
KGSHGGGGSGGGGSGGGGSFVSQHLCGSHLVEALYLVCGKRGFFYTPR;

(SEQ ID NO: 25083)
KGSHGGGGSGGGGSGGGGSFVTQHLCGSHLVEALYLVCGKRGFFYTPR;

(SEQ ID NO: 25084)
KGSHGGGGSGGGGSGGGGSFVGQHLCGSHLVEALYLVCGKRGFFYTPR;

(SEQ ID NO: 25085)
KGSHGGGGSGGGGSGGGGSFVNQHLCGSHLVEALYLVCGKRGFFYTPR;

(SEQ ID NO: 25086)
KGSHGGGGSGGGGSGGGGSHLCGSHLVEALYLVCGKRGFFYTPR;

(SEQ ID NO: 25087)
KGSHGGGGSGGGGSGGGGSFVNQHLCGSHLVEALYLVCGERGFFYTKPT;

(SEQ ID NO: 25088)
KGSHGGGGSGGGGSGGGGSFVGQHLCGSHLVEALYLVCGERGFFYTKPT;

(SEQ ID NO: 25089)
KGSHGGGGSGGGGSGGGGSHLCGSHLVEALYLVCGERGFFYTKPT;

(SEQ ID NO: 25090)
KGSHGGGGSGGGGSGGGGSFVNQHLCGSHLVEALYLVCGERGFFYTKP;

(SEQ ID NO: 25091)
KGSHGGGGSGGGGSGGGGSFVGQHLCGSHLVEALYLVCGERGFFYTKP;

(SEQ ID NO: 25092)
KGSHGGGGSGGGGSGGGGSHLCGSHLVEALYLVCGERGFFYTKP;

(SEQ ID NO: 25093)
KGSHGGGGSGGGGSGGGGSFVSQHLCGSHLVEALYLVCGERGFFYTPK;

(SEQ ID NO: 25094)
KGSHGGGGSGGGGSGGGGSFVTQHLCGSHLVEALYLVCGERGFFYTPK;

(SEQ ID NO: 25095)
KGSHGGGGSGGGGSGGGGSFVGQHLCGSHLVEALYLVCGERGFFYTPK;

(SEQ ID NO: 25096)
KGSHGGGGSGGGGSGGGGSFVNQHLCGSHLVEALYLVCGERGFFYTPK;

(SEQ ID NO: 25097)
KGSHGGGGSGGGGSGGGGSHLCGSHLVEALYLVCGERGFFYTPK;

(SEQ ID NO: 25098)
KGSHGGGGSGGGGSGGGGSFVNQHLCGSHLVEALYLVCGDRGFFYTKPT;

(SEQ ID NO: 25099)
KGSHGGGGSGGGGSGGGGSFVGQHLCGSHLVEALYLVCGDRGFFYTKPT;

(SEQ ID NO: 25100)
KGSHGGGGSGGGGSGGGGSHLCGSHLVEALYLVCGDRGFFYTKPT;

(SEQ ID NO: 25101)
KGSHGGGGSGGGGSGGGGSFVNQHLCGSHLVEALYLVCGDRGFFYTKP;

(SEQ ID NO: 25102)
KGSHGGGGSGGGGSGGGGSFVGQHLCGSHLVEALYLVCGDRGFFYTKP;

(SEQ ID NO: 25103)
KGSHGGGGSGGGGSGGGGSHLCGSHLVEALYLVCGDRGFFYTKP;

(SEQ ID NO: 25104)
KGSHGGGGSGGGGSGGGGSFVSQHLCGSHLVEALYLVCGDRGFFYTPK;

(SEQ ID NO: 25105)
KGSHGGGGSGGGGSGGGGSFVTQHLCGSHLVEALYLVCGDRGFFYTPK;

(SEQ ID NO: 25106)
KGSHGGGGSGGGGSGGGGSFVGQHLCGSHLVEALYLVCGDRGFFYTPK;

(SEQ ID NO: 25107)
KGSHGGGGSGGGGSGGGGSFVNQHLCGSHLVEALYLVCGDRGFFYTPK;

(SEQ ID NO: 25108)
KGSHGGGGSGGGGSGGGGSHLCGSHLVEALYLVCGDRGFFYTPK;

(SEQ ID NO: 25109)
KGSHGGGGSGGGGSGGGGSFVNQHLCGSHLVEALHLVCGKRGFFYTRPT;

(SEQ ID NO: 25110)
KGSHGGGGSGGGGSGGGGSFVGQHLCGSHLVEALHLVCGKRGFFYTRPT;
```

```
                                              (SEQ ID NO: 25111)
KGSHGGGGSGGGGSGGGGSHLCGSHLVEALHLVCGKRGFFYTRPT;

(SEQ ID NO: 25112)
KGSHGGGGSGGGGSGGGGSFVNQHLCGSHLVEALHLVCGKRGFFYTRP;

(SEQ ID NO: 25113)
KGSHGGGGSGGGGSGGGGSFVGQHLCGSHLVEALHLVCGKRGFFYTRP;

(SEQ ID NO: 25114)
KGSHGGGGSGGGGSGGGGSHLCGSHLVEALHLVCGKRGFFYTRP;

(SEQ ID NO: 25115)
KGSHGGGGSGGGGSGGGGSFVSQHLCGSHLVEALHLVCGKRGFFYTPR;

(SEQ ID NO: 25116)
KGSHGGGGSGGGGSGGGGSFVTQHLCGSHLVEALHLVCGKRGFFYTPR;

(SEQ ID NO: 25117)
KGSHGGGGSGGGGSGGGGSFVGQHLCGSHLVEALHLVCGKRGFFYTPR;

(SEQ ID NO: 25118)
KGSHGGGGSGGGGSGGGGSFVNQHLCGSHLVEALHLVCGKRGFFYTPR;

(SEQ ID NO: 25119)
KGSHGGGGSGGGGSGGGGSHLCGSHLVEALHLVCGKRGFFYTPR;

(SEQ ID NO: 25120)
KGSHGGGGSGGGGSGGGGSFVGQHLCGSHLVEALHLVCGDRGFFYTKPT;

(SEQ ID NO: 25121)
KGSHGGGGSGGGGSGGGGSHLCGSHLVEALHLVCGDRGFFYTKPT;

(SEQ ID NO: 25122)
KGSHGGGGSGGGGSGGGGSFVNQHLCGSHLVEALHLVCGDRGFFYTKP;

(SEQ ID NO: 25123)
KGSHGGGGSGGGGSGGGGSFVGQHLCGSHLVEALHLVCGDRGFFYTKP;

(SEQ ID NO: 25124)
KGSHGGGGSGGGGSGGGGSHLCGSHLVEALHLVCGDRGFFYTKP;

(SEQ ID NO: 25125)
KGSHGGGGSGGGGSGGGGSFVSQHLCGSHLVEALHLVCGDRGFFYTPK;

(SEQ ID NO: 25126)
KGSHGGGGSGGGGGGGGSFVTQHLCGSHLVEALHLVCGDRGFFYTPK;

(SEQ ID NO: 25127)
KGSHGGGGSGGGGSGGGGSFVGQHLCGSHLVEALHLVCGDRGFFYTPK;

(SEQ ID NO: 25128)
KGSHGGGGSGGGGSGGGGSFVNQHLCGSHLVEALHLVCGDRGFFYTPK;

(SEQ ID NO: 25129)
KGSHGGGGSGGGGSGGGGSHLCGSHLVEALHLVCGDRGFFYTPK;

(SEQ ID NO: 25130)
KGSHGGGGSGGGGSGGGGSFVNQHLCGSHLVEALHLVCGKRGFHYTRPT;

(SEQ ID NO: 25131)
KGSHGGGGSGGGGSGGGGSFVGQHLCGSHLVEALHLVCGKRGFHYTRPT;

(SEQ ID NO: 25132)
KGSHGGGGSGGGGSGGGGSHLCGSHLVEALHLVCGKRGFHYTRPT;

(SEQ ID NO: 25133)
KGSHGGGGSGGGGSGGGGSFVNQHLCGSHLVEALHLVCGKRGFHYTRP;

(SEQ ID NO: 25134)
KGSHGGGGSGGGGSGGGGSFVGQHLCGSHLVEALHLVCGKRGFHYTRP;

(SEQ ID NO: 25135)
KGSHGGGGSGGGGSGGGGSHLCGSHLVEALHLVCGKRGFHYTRP;

(SEQ ID NO: 25136)
KGSHGGGGSGGGGSGGGGSFVSQHLCGSHLVEALHLVCGKRGFHYTPR;

(SEQ ID NO: 25137)
KGSHGGGGSGGGGSGGGGSFVTQHLCGSHLVEALHLVCGKRGFHYTPR;

(SEQ ID NO: 25138)
KGSHGGGGSGGGGSGGGGSFVGQHLCGSHLVEALHLVCGKRGFHYTPR;

(SEQ ID NO: 25139)
KGSHGGGGSGGGGSGGGGSFVNQHLCGSHLVEALHLVCGKRGFHYTPR;

(SEQ ID NO: 25140)
KGSHGGGGSGGGGSGGGGSHLCGSHLVEALHLVCGKRGFHYTPR;

(SEQ ID NO: 25141)
KGSHGGGGSGGGGSGGGGSFVNQHLCGSHLVEALHLVCGDRGFHYTKPT;

(SEQ ID NO: 25142)
KGSHGGGGSGGGGSGGGGSFVGQHLCGSHLVEALHLVCGDRGFHYTKPT;

(SEQ ID NO: 25143)
KGSHGGGGSGGGGSGGGGSHLCGSHLVEALHLVCGDRGFHYTKPT;

(SEQ ID NO: 25144)
KGSHGGGGSGGGGSGGGGSFVNQHLCGSHLVEALHLVCGDRGFHYTKP;

(SEQ ID NO: 25145)
KGSHGGGGSGGGGSGGGGSFVGQHLCGSHLVEALHLVCGDRGFHYTKP;

(SEQ ID NO: 25146)
KGSHGGGGSGGGGSGGGGSHLCGSHLVEALHLVCGDRGFHYTKP;

(SEQ ID NO: 25147)
KGSHGGGGSGGGGSGGGGSFVSQHLCGSHLVEALHLVCGDRGFHYTPK;

(SEQ ID NO: 25148)
KGSHGGGGSGGGGSGGGGSFVTQHLCGSHLVEALHLVCGDRGFHYTPK;

(SEQ ID NO: 25149)
KGSHGGGGSGGGGSGGGGSFVGQHLCGSHLVEALHLVCGDRGFHYTPK;

(SEQ ID NO: 25150)
KGSHGGGGSGGGGSGGGGSFVNQHLCGSHLVEALHLVCGDRGFHYTPK;

(SEQ ID NO: 25151)
KGSHGGGGSGGGGSGGGGSHLCGSHLVEALHLVCGDRGFHYTPK;

(SEQ ID NO: 25152)
KGSHGGGGSGGGGSGGGGSGGGGSFVNQHLCGSHLVEALYLVCGKRGFFY
TRPT;

(SEQ ID NO: 25153)
KGSHGGGGSGGGGSGGGGSGGGGSFVGQHLCGSHLVEALYLVCGKRGFFY
TRPT;

(SEQ ID NO: 25154)
KGSHGGGGSGGGGSGGGGSGGGGSHLCGSHLVEALYLVCGKRGFFYTRP
T;

(SEQ ID NO: 25155)
KGSHGGGGSGGGGSGGGGSGGGGSFVNQHLCGSHLVEALYLVCGKRGFFY
TRP;

(SEQ ID NO: 25156)
KGSHGGGGSGGGGSGGGGSGGGGSFVGQHLCGSHLVEALYLVCGKRGFFY
TRP;

(SEQ ID NO: 25157)
KGSHGGGGSGGGGSGGGGSGGGGSHLCGSHLVEALYLVCGKRGFFYTRP;

(SEQ ID NO: 25158)
KGSHGGGGSGGGGSGGGGSGGGGSFVSQHLCGSHLVEALYLVCGKRGFFY
TPR;

(SEQ ID NO: 25159)
KGSHGGGGSGGGGSGGGGSGGGGSFVTQHLCGSHLVEALYLVCGKRGFFY
TPR;
```

(SEQ ID NO: 25160)
KGSHGGGGSGGGGSGGGGSGGGGSFVGQHLCGSHLVEALYLVCGKRGFFYTPR;

(SEQ ID NO: 25161)
KGSHGGGGSGGGGSGGGGSGGGGSFVNQHLCGSHLVEALYLVCGKRGFFYTPR;

(SEQ ID NO: 25162)
KGSHGGGGSGGGGSGGGGSGGGGSHLCGSHLVEALYLVCGKRGFFYTPR;

(SEQ ID NO: 25163)
KGSHGGGGSGGGGSGGGGSGGGGSFVNQHLCGSHLVEALYLVCGERGFFYTKPT;

(SEQ ID NO: 25164)
KGSHGGGGSGGGGSGGGGSGGGGSFVGQHLCGSHLVEALYLVCGERGFFYTKPT;

(SEQ ID NO: 25165)
KGSHGGGGSGGGGSGGGGSGGGGSHLCGSHLVEALYLVCGERGFFYTKPT;

(SEQ ID NO: 25166)
KGSHGGGGSGGGGSGGGGSGGGGSFVNQHLCGSHLVEALYLVCGERGFFYTKP;

(SEQ ID NO: 25167)
KGSHGGGGSGGGGSGGGGSGGGGSFVGQHLCGSHLVEALYLVCGERGFFYTKP;

(SEQ ID NO: 25168)
KGSHGGGGSGGGGSGGGGSGGGGSHLCGSHLVEALYLVCGERGFFYTKP;

(SEQ ID NO: 25169)
KGSHGGGGSGGGGSGGGGSGGGGSFVSQHLCGSHLVEALYLVCGERGFFYTPK;

(SEQ ID NO: 25170)
KGSHGGGGSGGGGSGGGGSGGGGSFVTQHLCGSHLVEALYLVCGERGFFYTPK;

(SEQ ID NO: 25171)
KGSHGGGGSGGGGSGGGGSGGGGSFVGQHLCGSHLVEALYLVCGERGFFYTPK;

(SEQ ID NO: 25172)
KGSHGGGGSGGGGSGGGGSGGGGSFVNQHLCGSHLVEALYLVCGERGFFYTPK;

(SEQ ID NO: 25173)
KGSHGGGGSGGGGSGGGGSGGGGSHLCGSHLVEALYLVCGERGFFYTPK;

(SEQ ID NO: 25174)
KGSHGGGGSGGGGSGGGGSGGGGSFVNQHLCGSHLVEALYLVCGDRGFFYTKPT;

(SEQ ID NO: 25175)
KGSHGGGGSGGGGSGGGGSGGGGSFVGQHLCGSHLVEALYLVCGDRGFFYTKPT;

(SEQ ID NO: 25176)
KGSHGGGGSGGGGSGGGGSGGGGSHLCGSHLVEALYLVCGDRGFFYTKPT;

(SEQ ID NO: 25177)
KGSHGGGGSGGGGSGGGGSGGGGSFVNQHLCGSHLVEALYLVCGDRGFFYTKP;

(SEQ ID NO: 25178)
KGSHGGGGSGGGGSGGGGSGGGGSFVGQHLCGSHLVEALYLVCGDRGFFYTKP;

(SEQ ID NO: 25179)
KGSHGGGGSGGGGSGGGGSGGGGSHLCGSHLVEALYLVCGDRGFFYTKP;

(SEQ ID NO: 25180)
KGSHGGGGSGGGGSGGGGSGGGGSFVSQHLCGSHLVEALYLVCGDRGFFYTPK;

(SEQ ID NO: 25181)
KGSHGGGGSGGGGSGGGGSGGGGSFVTQHLCGSHLVEALYLVCGDRGFFYTPK;

(SEQ ID NO: 25182)
KGSHGGGGSGGGGSGGGGSGGGGSFVGQHLCGSHLVEALYLVCGDRGFFYTPK;

(SEQ ID NO: 25183)
KGSHGGGGSGGGGSGGGGSGGGGSFVNQHLCGSHLVEALYLVCGDRGFFYTPK;

(SEQ ID NO: 25184)
KGSHGGGGSGGGGSGGGGSGGGGSHLCGSHLVEALYLVCGDRGFFYTPK;

(SEQ ID NO: 25185)
KGSHGGGGSGGGGSGGGGSGGGGSFVNQHLCGSHLVEALHLVCGKRGFFYTRPT;

(SEQ ID NO: 25186)
KGSHGGGGSGGGGSGGGGSGGGGSFVGQHLCGSHLVEALHLVCGKRGFFYTRPT;

(SEQ ID NO: 25187)
KGSHGGGGSGGGGSGGGGSGGGGSHLCGSHLVEALHLVCGKRGFFYTRPT;

(SEQ ID NO: 25188)
KGSHGGGGSGGGGSGGGGSGGGGSFVNQHLCGSHLVEALHLVCGKRGFFYTRP;

(SEQ ID NO: 25189)
KGSHGGGGSGGGGSGGGGSGGGGSFVGQHLCGSHLVEALHLVCGKRGFFYTRP;

(SEQ ID NO: 25190)
KGSHGGGGSGGGGSGGGGSGGGGSHLCGSHLVEALHLVCGKRGFFYTRP;

(SEQ ID NO: 25191)
KGSHGGGGSGGGGSGGGGSGGGGSFVSQHLCGSHLVEALHLVCGKRGFFYTPR;

(SEQ ID NO: 25192)
KGSHGGGGSGGGGSGGGGSGGGGSFVTQHLCGSHLVEALHLVCGKRGFFYTPR;

(SEQ ID NO: 25193)
KGSHGGGGSGGGGSGGGGSGGGGSFVGQHLCGSHLVEALHLVCGKRGFFYTPR;

```
(SEQ ID NO: 25194)
KGSHGGGGSGGGGSGGGGSGGGGSFVNQHLCGSHLVEALHLVCGKRGFFY
TPR;

(SEQ ID NO: 25195)
KGSHGGGGSGGGGSGGGGSGGGGSHLCGSHLVEALHLVCGKRGFFYTPR;

(SEQ ID NO: 25196)
KGSHGGGGSGGGGSGGGGSGGGGSFVGQHLCGSHLVEALHLVCGDRGFFY
TKPT;

(SEQ ID NO: 25197)
KGSHGGGGSGGGGSGGGGSGGGGSHLCGSHLVEALHLVCGDRGFFYTKP
T;

(SEQ ID NO: 25198)
KGSHGGGGSGGGGSGGGGSGGGGSFVNQHLCGSHLVEALHLVCGDRGFFY
TKP;

(SEQ ID NO: 25199)
KGSHGGGGSGGGGSGGGGSGGGGSFVGQHLCGSHLVEALHLVCGDRGFFY
TKP;

(SEQ ID NO: 25200)
KGSHGGGGSGGGGSGGGGSGGGGSHLCGSHLVEALHLVCGDRGFFYTKP;

(SEQ ID NO: 25201)
KGSHGGGGSGGGGSGGGGSGGGGSFVSQHLCGSHLVEALHLVCGDRGFFY
TPK;

(SEQ ID NO: 25202)
KGSHGGGGSGGGGSGGGGSGGGGSFVTQHLCGSHLVEALHLVCGDRGFFY
TPK;

(SEQ ID NO: 25203)
KGSHGGGGSGGGGSGGGGSGGGGSFVGQHLCGSHLVEALHLVCGDRGFFY
TPK;

(SEQ ID NO: 25204)
KGSHGGGGSGGGGSGGGGSGGGGSFVNQHLCGSHLVEALHLVCGDRGFFY
TPK;

(SEQ ID NO: 25205)
KGSHGGGGSGGGGSGGGGSGGGGSHLCGSHLVEALHLVCGDRGFFYTPK;

(SEQ ID NO: 25206)
KGSHGGGGSGGGGSGGGGSGGGGSFVNQHLCGSHLVEALHLVCGKRGFHY
TRPT;

(SEQ ID NO: 25207)
KGSHGGGGSGGGGSGGGGSGGGGSFVGQHLCGSHLVEALHLVCGKRGFHY
TRPT;

(SEQ ID NO: 25208)
KGSHGGGGSGGGGSGGGGSGGGGSHLCGSHLVEALHLVCGKRGFHYTRP
T;

(SEQ ID NO: 25209)
KGSHGGGGSGGGGSGGGGSGGGGSFVNQHLCGSHLVEALHLVCGKRGFHY
TRP;

(SEQ ID NO: 25210)
KGSHGGGGSGGGGSGGGGSGGGGSFVGQHLCGSHLVEALHLVCGKRGFHY
TRP;

(SEQ ID NO: 25211)
KGSHGGGGSGGGGSGGGGSGGGGSHLCGSHLVEALHLVCGKRGFHYTRP;

(SEQ ID NO: 25212)
KGSHGGGGSGGGGSGGGGSGGGGSFVSQHLCGSHLVEALHLVCGKRGFHY
TPR;

(SEQ ID NO: 25213)
KGSHGGGGSGGGGSGGGGSGGGGSFVTQHLCGSHLVEALHLVCGKRGFHY
TPR;

(SEQ ID NO: 25214)
KGSHGGGGSGGGGSGGGGSGGGGSFVGQHLCGSHLVEALHLVCGKRGFHY
TPR;

(SEQ ID NO: 25215)
KGSHGGGGSGGGGSGGGGSGGGGSFVNQHLCGSHLVEALHLVCGKRGFHY
TPR;

(SEQ ID NO: 25216)
KGSHGGGGSGGGGSGGGGSGGGGSHLCGSHLVEALHLVCGKRGFHYTPR;

(SEQ ID NO: 25217)
KGSHGGGGSGGGGSGGGGSGGGGSFVNQHLCGSHLVEALHLVCGDRGFHY
TKPT;

(SEQ ID NO: 25218)
KGSHGGGGSGGGGSGGGGSGGGGSFVGQHLCGSHLVEALHLVCGDRGFHY
TKPT;

(SEQ ID NO: 25219)
KGSHGGGGSGGGGSGGGGSGGGGSHLCGSHLVEALHLVCGDRGFHYTKP
T;

(SEQ ID NO: 25220)
KGSHGGGGSGGGGSGGGGSGGGGSFVNQHLCGSHLVEALHLVCGDRGFHY
TKP;

(SEQ ID NO: 25221)
KGSHGGGGSGGGGSGGGGSGGGGSFVGQHLCGSHLVEALHLVCGDRGFHY
TKP;

(SEQ ID NO: 25222)
KGSHGGGGSGGGGSGGGGSGGGGSHLCGSHLVEALHLVCGDRGFHYTKP;

(SEQ ID NO: 25223)
KGSHGGGGSGGGGSGGGGSGGGGSFVSQHLCGSHLVEALHLVCGDRGFHY
TPK;

(SEQ ID NO: 25224)
KGSHGGGGSGGGGSGGGGSGGGGSFVTQHLCGSHLVEALHLVCGDRGFHY
TPK;

(SEQ ID NO: 25225)
KGSHGGGGSGGGGSGGGGSGGGGSFVGQHLCGSHLVEALHLVCGDRGFHY
TPK;

(SEQ ID NO: 25226)
KGSHGGGGSGGGGSGGGGSGGGGSFVNQHLCGSHLVEALHLVCGDRGFHY
TPK;

(SEQ ID NO: 25227)
KGSHGGGGSGGGGSGGGGSGGGGSHLCGSHLVEALHLVCGDRGFHYTPK;

(SEQ ID NO: 25228)
GKGSHKFVNQHLCGSHLVEALYLVCGKRGFFYTPR;
```

```
                                              (SEQ ID NO: 25229)
GKGSHKFVGQHLCGSHLVEALYLVCGKRGFFYTRPT;

(SEQ ID NO: 25230)
GKGSHKHLCGSHLVEALYLVCGKRGFFYTRPT;

(SEQ ID NO: 25231)
GKGSHKFVNQHLCGSHLVEALYLVCGKRGFFYTRP;

(SEQ ID NO: 25232)
GKGSHKFVGQHLCGSHLVEALYLVCGKRGFFYTRP;

(SEQ ID NO: 25233)
GKGSHKHLCGSHLVEALYLVCGKRGFFYTRP;

(SEQ ID NO: 25234)
GKGSHKFVSQHLCGSHLVEALYLVCGKRGFFYTPR;

(SEQ ID NO: 25235)
GKGSHKFVTQHLCGSHLVEALYLVCGKRGFFYTPR;

(SEQ ID NO: 25236)
GKGSHKFVGQHLCGSHLVEALYLVCGKRGFFYTPR;

(SEQ ID NO: 25237)
GKGSHKFVNQHLCGSHLVEALYLVCGKRGFFYTPRT;

(SEQ ID NO: 25238)
GKGSHKHLCGSHLVEALYLVCGKRGFFYTPR;

(SEQ ID NO: 25239)
GKGSHKFVNQHLCGSHLVEALYLVCGERGFFYTKPT;

(SEQ ID NO: 25240)
GKGSHKFVGQHLCGSHLVEALYLVCGERGFFYTKPT;

(SEQ ID NO: 25241)
GKGSHKHLCGSHLVEALYLVCGERGFFYTKPT;

(SEQ ID NO: 25242)
GKGSHKFVNQHLCGSHLVEALYLVCGERGFFYTKP;

(SEQ ID NO: 25243)
GKGSHKFVGQHLCGSHLVEALYLVCGERGFFYTKP;

(SEQ ID NO: 25244)
GKGSHKHLCGSHLVEALYLVCGERGFFYTKP;

(SEQ ID NO: 25245)
GKGSHKFVSQHLCGSHLVEALYLVCGERGFFYTPK;

(SEQ ID NO: 25246)
GKGSHKFVTQHLCGSHLVEALYLVCGERGFFYTPK;

(SEQ ID NO: 25247)
GKGSHKFVGQHLCGSHLVEALYLVCGERGFFYTPK;

(SEQ ID NO: 25248)
GKGSHKFVNQHLCGSHLVEALYLVCGERGFFYTPK;

(SEQ ID NO: 25249)
GKGSHKHLCGSHLVEALYLVCGERGFFYTPK;

(SEQ ID NO: 25250)
GKGSHKFVNQHLCGSHLVEALYLVCGDRGFFYTKPT;

(SEQ ID NO: 25251)
GKGSHKFVGQHLCGSHLVEALYLVCGDRGFFYTKPT;

(SEQ ID NO: 25252)
GKGSHKHLCGSHLVEALYLVCGDRGFFYTKPT;

(SEQ ID NO: 25253)
GKGSHKFVNQHLCGSHLVEALYLVCGDRGFFYTKP;

(SEQ ID NO: 25254)
GKGSHKFVGQHLCGSHLVEALYLVCGDRGFFYTKP;

(SEQ ID NO: 25255)
GKGSHKHLCGSHLVEALYLVCGDRGFFYTKP;

(SEQ ID NO: 25256)
GKGSHKFVSQHLCGSHLVEALYLVCGDRGFFYTPK;

(SEQ ID NO: 25257)
GKGSHKFVTQHLCGSHLVEALYLVCGDRGFFYTPK;

(SEQ ID NO: 25258)
GKGSHKFVGQHLCGSHLVEALYLVCGDRGFFYTPK;

(SEQ ID NO: 25259)
GKGSHKFVNQHLCGSHLVEALYLVCGDRGFFYTPK;

(SEQ ID NO: 25260)
GKGSHKHLCGSHLVEALYLVCGDRGFFYTPK;

(SEQ ID NO: 25261)
GKGSHKFVNQHLCGSHLVEALHLVCGKRGFFYTRPT;

(SEQ ID NO: 25262)
GKGSHKFVGQHLCGSHLVEALHLVCGKRGFFYTRPT;

(SEQ ID NO: 25263)
GKGSHKHLCGSHLVEALHLVCGKRGFFYTRPT;

(SEQ ID NO: 25264)
GKGSHKFVNQHLCGSHLVEALHLVCGKRGFFYTRP;

(SEQ ID NO: 25265)
GKGSHKFVGQHLCGSHLVEALHLVCGKRGFFYTRP;

(SEQ ID NO: 25266)
GKGSHKHLCGSHLVEALHLVCGKRGFFYTRP;

(SEQ ID NO: 25267)
GKGSHKFVSQHLCGSHLVEALHLVCGKRGFFYTPR;

(SEQ ID NO: 25268)
GKGSHKFVTQHLCGSHLVEALHLVCGKRGFFYTPR;

(SEQ ID NO: 25269)
GKGSHKFVGQHLCGSHLVEALHLVCGKRGFFYTPR;

(SEQ ID NO: 25270)
GKGSHKFVNQHLCGSHLVEALHLVCGKRGFFYTPR;

(SEQ ID NO: 25271)
GKGSHKHLCGSHLVEALHLVCGKRGFFYTPR;

(SEQ ID NO: 25272)
GKGSHKFVGQHLCGSHLVEALHLVCGDRGFFYTKPT;

(SEQ ID NO: 25273)
GKGSHKHLCGSHLVEALHLVCGDRGFFYTKPT;

(SEQ ID NO: 25274)
GKGSHKFVNQHLCGSHLVEALHLVCGDRGFFYTKP;

(SEQ ID NO: 25275)
GKGSHKFVGQHLCGSHLVEALHLVCGDRGFFYTKP;

(SEQ ID NO: 25276)
GKGSHKHLCGSHLVEALHLVCGDRGFFYTKP;

(SEQ ID NO: 25277)
GKGSHKFVSQHLCGSHLVEALHLVCGDRGFFYTPK;

(SEQ ID NO: 25278)
GKGSHKFVTQHLCGSHLVEALHLVCGDRGFFYTPK;

(SEQ ID NO: 25279)
GKGSHKFVGQHLCGSHLVEALHLVCGDRGFFYTPK;

(SEQ ID NO: 25280)
GKGSHKFVNQHLCGSHLVEALHLVCGDRGFFYTPK;

(SEQ ID NO: 25281)
GKGSHKHLCGSHLVEALHLVCGDRGFFYTPK;

(SEQ ID NO: 25282)
GKGSHKFVNQHLCGSHLVEALHLVCGKRGFHYTRPT;
```

```
                                                    (SEQ ID NO: 25283)
GKGSHKFVGQHLCGSHLVEALHLVCGKRGFHYTRPT;

(SEQ ID NO: 25284)
GKGSHKHLCGSHLVEALHLVCGKRGFHYTRPT;

(SEQ ID NO: 25285)
GKGSHKFVNQHLCGSHLVEALHLVCGKRGFHYTRP;

(SEQ ID NO: 25286)
GKGSHKFVGQHLCGSHLVEALHLVCGKRGFHYTRP;

(SEQ ID NO: 25287)
GKGSHKHLCGSHLVEALHLVCGKRGFHYTRP;

(SEQ ID NO: 25288)
GKGSHKFVSQHLCGSHLVEALHLVCGKRGFHYTPR;

(SEQ ID NO: 25289)
GKGSHKFVTQHLCGSHLVEALHLVCGKRGFHYTPR;

(SEQ ID NO: 25290)
GKGSHKFVGQHLCGSHLVEALHLVCGKRGFHYTPR;

(SEQ ID NO: 25291)
GKGSHKFVNQHLCGSHLVEALHLVCGKRGFHYTPR;

(SEQ ID NO: 25292)
GKGSHKHLCGSHLVEALHLVCGKRGFHYTPR;

(SEQ ID NO: 25293)
GKGSHKFVNQHLCGSHLVEALHLVCGDRGFHYTKPT;

(SEQ ID NO: 25294)
GKGSHKFVGQHLCGSHLVEALHLVCGDRGFHYTKPT;

(SEQ ID NO: 25295)
GKGSHKHLCGSHLVEALHLVCGDRGFHYTKPT;

(SEQ ID NO: 25296)
GKGSHKFVNQHLCGSHLVEALHLVCGDRGFHYTKP;

(SEQ ID NO: 25297)
GKGSHKFVGQHLCGSHLVEALHLVCGDRGFHYTKP;

(SEQ ID NO: 25298)
GKGSHKHLCGSHLVEALHLVCGDRGFHYTKP;

(SEQ ID NO: 25299)
GKGSHKFVSQHLCGSHLVEALHLVCGDRGFHYTPK;

(SEQ ID NO: 25300)
GKGSHKFVTQHLCGSHLVEALHLVCGDRGFHYTPK;

(SEQ ID NO: 25301)
GKGSHKFVGQHLCGSHLVEALHLVCGDRGFHYTPK;

(SEQ ID NO: 25302)
GKGSHKFVNQHLCGSHLVEALHLVCGDRGFHYTPK;

(SEQ ID NO: 25303)
GKGSHKHLCGSHLVEALHLVCGDRGFHYTPK;

(SEQ ID NO: 25304)
KGSHKFVNQHLCGSHLVEALYLVCGKRGFFYTRPT;

(SEQ ID NO: 25305)
KGSHKFVGQHLCGSHLVEALYLVCGKRGFFYTRPT;

(SEQ ID NO: 25306)
KGSHKHLCGSHLVEALYLVCGKRGFFYTRPT;

(SEQ ID NO: 25307)
KGSHKFVNQHLCGSHLVEALYLVCGKRGFFYTRP;

(SEQ ID NO: 25308)
KGSHKFVGQHLCGSHLVEALYLVCGKRGFFYTRP;

(SEQ ID NO: 25309)
KGSHKHLCGSHLVEALYLVCGKRGFFYTRP;

(SEQ ID NO: 25310)
KGSHKFVSQHLCGSHLVEALYLVCGKRGFFYTPR;

(SEQ ID NO: 25311)
KGSHKFVTQHLCGSHLVEALYLVCGKRGFFYTPR;

(SEQ ID NO: 25312)
KGSHKFVGQHLCGSHLVEALYLVCGKRGFFYTPR;

(SEQ ID NO: 25313)
KGSHKFVNQHLCGSHLVEALYLVCGKRGFFYTPR;

(SEQ ID NO: 25314)
KGSHKHLCGSHLVEALYLVCGKRGFFYTPR;

(SEQ ID NO: 25315)
KGSHKFVNQHLCGSHLVEALYLVCGERGFFYTKPT;

(SEQ ID NO: 25316)
KGSHKFVGQHLCGSHLVEALYLVCGERGFFYTKPT;

(SEQ ID NO: 25317)
KGSHKHLCGSHLVEALYLVCGERGFFYTKPT;

(SEQ ID NO: 25318)
KGSHKFVNQHLCGSHLVEALYLVCGERGFFYTKP;

(SEQ ID NO: 25319)
KGSHKFVGQHLCGSHLVEALYLVCGERGFFYTKP;

(SEQ ID NO: 25320)
KGSHKHLCGSHLVEALYLVCGERGFFYTKP;

(SEQ ID NO: 25321)
KGSHKFVSQHLCGSHLVEALYLVCGERGFFYTPK;

(SEQ ID NO: 25322)
KGSHKFVTQHLCGSHLVEALYLVCGERGFFYTPK;

(SEQ ID NO: 25323)
KGSHKFVGQHLCGSHLVEALYLVCGERGFFYTPK;

(SEQ ID NO: 25324)
KGSHKFVNQHLCGSHLVEALYLVCGERGFFYTPK;

(SEQ ID NO: 25325)
KGSHKHLCGSHLVEALYLVCGERGFFYTPK;

(SEQ ID NO: 25326)
KGSHKFVNQHLCGSHLVEALYLVCGDRGFFYTKPT;

(SEQ ID NO: 25327)
KGSHKFVGQHLCGSHLVEALYLVCGDRGFFYTKPT;

(SEQ ID NO: 25328)
KGSHKHLCGSHLVEALYLVCGDRGFFYTKPT;

(SEQ ID NO: 25329)
KGSHKFVNQHLCGSHLVEALYLVCGDRGFFYTKP;

(SEQ ID NO: 25330)
KGSHKFVGQHLCGSHLVEALYLVCGDRGFFYTKP;

(SEQ ID NO: 25331)
KGSHKHLCGSHLVEALYLVCGDRGFFYTKP;

(SEQ ID NO: 25332)
KGSHKFVSQHLCGSHLVEALYLVCGDRGFFYTPK;

(SEQ ID NO: 25333)
KGSHKFVTQHLCGSHLVEALYLVCGDRGFFYTPK;

(SEQ ID NO: 25334)
KGSHKFVGQHLCGSHLVEALYLVCGDRGFFYTPK;

(SEQ ID NO: 25335)
KGSHKFVNQHLCGSHLVEALYLVCGDRGFFYTPK;

(SEQ ID NO: 25336)
KGSHKHLCGSHLVEALYLVCGDRGFFYTPK;
```

KGSHKFVNQHLCGSHLVEALHLVCGKRGFFYTRPT; (SEQ ID NO: 25337)

KGSHKFVGQHLCGSHLVEALHLVCGKRGFFYTRPT; (SEQ ID NO: 25338)

KGSHKHLCGSHLVEALHLVCGKRGFFYTRPT; (SEQ ID NO: 25339)

KGSHKFVNQHLCGSHLVEALHLVCGKRGFFYTRP; (SEQ ID NO: 25340)

KGSHKFVGQHLCGSHLVEALHLVCGKRGFFYTRP; (SEQ ID NO: 25341)

KGSHKHLCGSHLVEALHLVCGKRGFFYTRP; (SEQ ID NO: 25342)

KGSHKFVSQHLCGSHLVEALHLVCGKRGFFYTPR; (SEQ ID NO: 25343)

KGSHKFVTQHLCGSHLVEALHLVCGKRGFFYTPR; (SEQ ID NO: 25344)

KGSHKFVGQHLCGSHLVEALHLVCGKRGFFYTPR; (SEQ ID NO: 25345)

KGSHKFVNQHLCGSHLVEALHLVCGKRGFFYTPR; (SEQ ID NO: 25346)

KGSHKHLCGSHLVEALHLVCGKRGFFYTPR; (SEQ ID NO: 25347)

KGSHKFVGQHLCGSHLVEALHLVCGDRGFFYTKPT; (SEQ ID NO: 25348)

KGSHKHLCGSHLVEALHLVCGDRGFFYTKPT; (SEQ ID NO: 25349)

KGSHKFVNQHLCGSHLVEALHLVCGDRGFFYTKP; (SEQ ID NO: 25350)

KGSHKFVGQHLCGSHLVEALHLVCGDRGFFYTKP; (SEQ ID NO: 25351)

KGSHKHLCGSHLVEALHLVCGDRGFFYTKP; (SEQ ID NO: 25352)

KGSHKFVSQHLCGSHLVEALHLVCGDRGFFYTPK; (SEQ ID NO: 25353)

KGSHKFVTQHLCGSHLVEALHLVCGDRGFFYTPK; (SEQ ID NO: 25354)

KGSHKFVGQHLCGSHLVEALHLVCGDRGFFYTPK; (SEQ ID NO: 25355)

KGSHKFVNQHLCGSHLVEALHLVCGDRGFFYTPK; (SEQ ID NO: 25356)

KGSHKHLCGSHLVEALHLVCGDRGFFYTPK; (SEQ ID NO: 25357)

KGSHKFVNQHLCGSHLVEALHLVCGKRGFHYTRPT; (SEQ ID NO: 25358)

KGSHKFVGQHLCGSHLVEALHLVCGKRGFHYTRPT; (SEQ ID NO: 25359)

KGSHKHLCGSHLVEALHLVCGKRGFHYTRPT; (SEQ ID NO: 25360)

KGSHKFVNQHLCGSHLVEALHLVCGKRGFHYTRP; (SEQ ID NO: 25361)

KGSHKFVGQHLCGSHLVEALHLVCGKRGFHYTRP; (SEQ ID NO: 25362)

KGSHKHLCGSHLVEALHLVCGKRGFHYTRP; (SEQ ID NO: 25363)

KGSHKFVSQHLCGSHLVEALHLVCGKRGFHYTPR; (SEQ ID NO: 25364)

KGSHKFVTQHLCGSHLVEALHLVCGKRGFHYTPR; (SEQ ID NO: 25365)

KGSHKFVGQHLCGSHLVEALHLVCGKRGFHYTPR; (SEQ ID NO: 25366)

KGSHKFVNQHLCGSHLVEALHLVCGKRGFHYTPR; (SEQ ID NO: 25367)

KGSHKHLCGSHLVEALHLVCGKRGFHYTPR; (SEQ ID NO: 25368)

KGSHKFVNQHLCGSHLVEALHLVCGDRGFHYTKPT; (SEQ ID NO: 25369)

KGSHKFVGQHLCGSHLVEALHLVCGDRGFHYTKPT; (SEQ ID NO: 25370)

KGSHKHLCGSHLVEALHLVCGDRGFHYTKPT; (SEQ ID NO: 25371)

KGSHKFVNQHLCGSHLVEALHLVCGDRGFHYTKP; (SEQ ID NO: 25372)

KGSHKFVGQHLCGSHLVEALHLVCGDRGFHYTKP; (SEQ ID NO: 25373)

KGSHKHLCGSHLVEALHLVCGDRGFHYTKP; (SEQ ID NO: 25374)

KGSHKFVSQHLCGSHLVEALHLVCGDRGFHYTPK; (SEQ ID NO: 25375)

KGSHKFVTQHLCGSHLVEALHLVCGDRGFHYTPK; (SEQ ID NO: 25376)

KGSHKFVGQHLCGSHLVEALHLVCGDRGFHYTPK; (SEQ ID NO: 25377)

KGSHKFVNQHLCGSHLVEALHLVCGDRGFHYTPK; (SEQ ID NO: 25378)

KGSHKHLCGSHLVEALHLVCGDRGFHYTPK; (SEQ ID NO: 25379)

KGSHKFVGQHLCGSHLVEALYLVCGKRGFFYTPRT; (SEQ ID NO: 25380)

GKGSHKFVGQHLCGSHLVEALYLVCGKRGFFYTPRT; (SEQ ID NO: 25381)

KGGGGSGGGGSGGGGSFVGQHLCGSHLVEALYLVCGERGFFYTPK; (SEQ ID NO: 25382)

-continued

GKGGGGSGGGGSGGGGSFVGQHLCGSHLVEALYLVCGERGFFYTPK; (SEQ ID NO: 25383)

KGGGGSGGGGSGGGGSFVGQHLCGSHLVEALYLVCGERGFFYTPKT; (SEQ ID NO: 25384)

GKGGGGSGGGGSGGGGSFVGQHLCGSHLVEALYLVCGERGFFYTPKT; (SEQ ID NO: 25385)

KGSHGGGGSGGGGSGGGGSFVGQHLCGSHLVEALYLVCGERGFFYTPKT; (SEQ ID NO: 25386)

GKGSHGGGGSGGGGSGGGGSFVGQHLCGSHLVEALYLVCGERGFFYTPK; (SEQ ID NO: 25387)

GKGSHGGGGSGGGGSGGGGSFVGQHLCGSHLVEALYLVCGERGFFYTPKT; (SEQ ID NO: 25388)

KGGGGSGGGGSGGGGSFVGQHLCGSHLVEALYLVCGKRGFFYTPR; (SEQ ID NO: 25389)

GKGGGGSGGGGSGGGGSFVGQHLCGSHLVEALYLVCGKRGFFYTPR; (SEQ ID NO: 25390)

KGGGGSGGGGSGGGGSFVGQHLCGSHLVEALYLVCGKRGFFYTPRT; (SEQ ID NO: 25391)

GKGGGGSGGGGSGGGGSFVGQHLCGSHLVEALYLVCGKRGFFYTPRT; (SEQ ID NO: 25392)

KGSHKFVDQHLCGSHLVEALYLVCGKRGFFYTPR; (SEQ ID NO: 25393)

KFVDQHLCGSHLVEALYLVCGKRGFFYTPKT; (SEQ ID NO: 25394)

KGGGGSGGGGSGGGGSFVNQHLCGSHLVEALYLVCGERGFFYTPK; (SEQ ID NO: 25395)

GKGSHKFVNQHLCGSHLVEALYLVCGKRGFFYTRPT; and (SEQ ID NO: 25396)

GKGGGGSGGGGSGGGGSFVNQHLCGSHLVEALYLVCGERGFFYTPK. (SEQ ID NO: 25397)

SEQUENCE LISTING (25746 sequences)

SEQ ID NO: 1 - protein, 21 aa, Homo sapiens
GIVEQCCTSICSLYQLENYCN

SEQ ID NO: 2 - protein, 30 aa, synthetic construct
FVNQHLCGSHLVEALYLVCGERGFFYTPKT

SEQ ID NO: 3-23 - skipped (21 entries)

SEQ ID NO: 24 - protein, 22 aa, Homo sapiens
GIVEQCCTSICSLYQLENYCGK

SEQ ID NO: 25 - protein, 22 aa, Homo sapiens
GIVEQCCTSICSLYQLENYCGK

SEQ ID NO: 26-24050 - skipped (24025 entries)

SEQ ID NO: 24051 - protein, 21 aa, Homo sapiens
GIVEQCCTSICSLYQLENYCG

SEQ ID NO: 24052 - protein, 21 aa, Homo sapiens
GIVEQCCTSICSLEQLENYCG

SEQ ID NO: 24053-24059 - skipped (7 entries)

SEQ ID NO: 24060 - protein, 31 aa, synthetic construct
KFVNQHLCGSHLVEALYLVCGKRGFFYTPKT

SEQ ID NO: 24061 - protein, 33 aa, synthetic construct
KGSHFVNQHLCGSHLVEALYLVCGKRGFFYTPR

SEQ ID NO: 24062 - protein, 30 aa, synthetic construct
KGSHQHLCGSHLVEALYLVCGKRGFFYTPR

SEQ ID NO: 24063 - protein, 31 aa, synthetic construct
KGSHKQHLCGSHLVEALYLVCGKRGFFYTPR

SEQ ID NO: 24064 - protein, 47 aa, synthetic construct
GKPGGGGSGGGGSGGGGSFVNQHLCGSHLVEALYLVCGDRGFFYTPK

SEQ ID NO: 24065-24999 - skipped (935 entries)

SEQ ID NO: 25000 - protein, 31 aa, synthetic construct
KFVNQHLCGSHLVEALYLVCGKRGFFYTRPT

SEQ ID NO: 25001 - protein, 31 aa, synthetic construct
KFVGQHLCGSHLVEALYLVCGKRGFFYTRPT

SEQ ID NO: 25002 - protein, 27 aa, synthetic construct
KHLCGSHLVEALYLVCGKRGFFYTRPT

SEQ ID NO: 25003 - protein, 30 aa, synthetic construct
KFVNQHLCGSHLVEALYLVCGKRGFFYTRP

SEQ ID NO: 25004 - protein, 30 aa, synthetic construct
KFVGQHLCGSHLVEALYLVCGKRGFFYTRP

SEQ ID NO: 25005 - protein, 26 aa, synthetic construct
KHLCGSHLVEALYLVCGKRGFFYTRP

SEQ ID NO: 25006 - protein, 30 aa, synthetic construct
KFVSQHLCGSHLVEALYLVCGKRGFFYTPR

SEQ ID NO: 25007 - protein, 30 aa, synthetic construct
KFVTQHLCGSHLVEALYLVCGKRGFFYTPR

SEQ ID NO: 25008 - protein, 30 aa, synthetic construct
KFVGQHLCGSHLVEALYLVCGKRGFFYTPR

SEQ ID NO: 25009 - protein, 30 aa, synthetic construct
KFVNQHLCGSHLVEALYLVCGKRGFFYTPR

SEQ ID NO: 25010 - protein, 26 aa, synthetic construct
KHLCGSHLVEALYLVCGKRGFFYTPR

SEQ ID NO: 25011 - protein, 31 aa, synthetic construct
KFVNQHLCGSHLVEALYLVCGERGFFYTKPT

SEQ ID NO: 25012 - protein, 31 aa, synthetic construct
KFVGQHLCGSHLVEALYLVCGERGFFYTKPT

SEQ ID NO: 25013 - protein, 27 aa, synthetic construct
KHLCGSHLVEALYLVCGERGFFYTKPT

SEQ ID NO: 25014 - protein, 30 aa, synthetic construct
KFVNQHLCGSHLVEALYLVCGERGFFYTKP

SEQ ID NO: 25015 - protein, 30 aa, synthetic construct
KFVGQHLCGSHLVEALYLVCGERGFFYTKP

SEQ ID NO: 25016 - protein, 26 aa, synthetic construct
KHLCGSHLVEALYLVCGERGFFYTKP

SEQ ID NO: 25017 - protein, 30 aa, synthetic construct
KFVSQHLCGSHLVEALYLVCGERGFFYTPK

SEQ ID NO: 25018 - protein, 30 aa, synthetic construct
KFVTQHLCGSHLVEALYLVCGERGFFYTPK

SEQ ID NO: 25019 - protein, 30 aa, synthetic construct
KFVGQHLCGSHLVEALYLVCGERGFFYTPK

SEQ ID NO: 25020 - protein, 30 aa, synthetic construct
KFVNQHLCGSHLVEALYLVCGERGFFYTPK

SEQ ID NO: 25021 - protein, 26 aa, synthetic construct
KHLCGSHLVEALYLVCGERGFFYTPK

SEQ ID NO: 25022 - protein, 31 aa, synthetic construct
KFVNQHLCGSHLVEALYLVCGDRGFFYTKPT

SEQ ID NO: 25023 - protein, 31 aa, synthetic construct
KFVGQHLCGSHLVEALYLVCGDRGFFYTKPT

SEQ ID NO: 25024 - protein, 27 aa, synthetic construct
KHLCGSHLVEALYLVCGDRGFFYTKPT

SEQ ID NO: 25025 - protein, 30 aa, synthetic construct
KFVNQHLCGSHLVEALYLVCGDRGFFYTKP

SEQ ID NO: 25026 - protein, 30 aa, synthetic construct
KFVGQHLCGSHLVEALYLVCGDRGFFYTKP

SEQ ID NO: 25027 - protein, 26 aa, synthetic construct
KHLCGSHLVEALYLVCGDRGFFYTKP

SEQ ID NO: 25028 - protein, 30 aa, synthetic construct
KFVSQHLCGSHLVEALYLVCGDRGFFYTPK

SEQ ID NO: 25029 - protein, 30 aa, synthetic construct
KFVTQHLCGSHLVEALYLVCGDRGFFYTPK

SEQ ID NO: 25030 - protein, 30 aa, synthetic construct
KFVGQHLCGSHLVEALYLVCGDRGFFYTPK

SEQ ID NO: 25031 - protein, 30 aa, synthetic construct
KFVNQHLCGSHLVEALYLVCGDRGFFYTPK

SEQ ID NO: 25032 - protein, 26 aa, synthetic construct
KHLCGSHLVEALYLVCGDRGFFYTPK

SEQ ID NO: 25033 - protein, 31 aa, synthetic construct
KFVNQHLCGSHLVEALHLVCGKRGFFYTRPT

SEQ ID NO: 25034 - protein, 31 aa, synthetic construct
KFVGQHLCGSHLVEALHLVCGKRGFFYTRPT

SEQ ID NO: 25035 - protein, 27 aa, synthetic construct
KHLCGSHLVEALHLVCGKRGFFYTRPT

SEQ ID NO: 25036 - protein, 30 aa, synthetic construct
KFVNQHLCGSHLVEALHLVCGKRGFFYTRP

SEQ ID NO: 25037 - protein, 30 aa, synthetic construct
KFVGQHLCGSHLVEALHLVCGKRGFFYTRP

SEQ ID NO: 25038 - protein, 26 aa, synthetic construct
KHLCGSHLVEALHLVCGKRGFFYTRP

SEQ ID NO: 25039 - protein, 30 aa, synthetic construct
KFVSQHLCGSHLVEALHLVCGKRGFFYTPR

SEQ ID NO: 25040 - protein, 30 aa, synthetic construct
KFVTQHLCGSHLVEALHLVCGKRGFFYTPR

SEQ ID NO: 25041 - protein, 30 aa, synthetic construct
KFVGQHLCGSHLVEALHLVCGKRGFFYTPR

SEQ ID NO: 25042 - protein, 30 aa, synthetic construct
KFVNQHLCGSHLVEALHLVCGKRGFFYTPR

SEQ ID NO: 25043 - protein, 26 aa, synthetic construct
KHLCGSHLVEALHLVCGKRGFFYTPR

SEQ ID NO: 25044 - protein, 31 aa, synthetic construct
KFVGQHLCGSHLVEALHLVCGDRGFFYTKPT

SEQ ID NO: 25045 - protein, 27 aa, synthetic construct
KHLCGSHLVEALHLVCGDRGFFYTKPT

SEQ ID NO: 25046 - protein, 30 aa, synthetic construct
KFVNQHLCGSHLVEALHLVCGDRGFFYTKP

SEQ ID NO: 25047 - protein, 30 aa, synthetic construct
KFVGQHLCGSHLVEALHLVCGDRGFFYTKP

SEQ ID NO: 25048 - protein, 26 aa, synthetic construct
KHLCGSHLVEALHLVCGDRGFFYTKP

SEQ ID NO: 25049 - protein, 30 aa, synthetic construct
KFVSQHLCGSHLVEALHLVCGDRGFFYTPK

SEQ ID NO: 25050 - protein, 30 aa, synthetic construct
KFVTQHLCGSHLVEALHLVCGDRGFFYTPK

SEQ ID NO: 25051 - protein, 30 aa, synthetic construct
KFVGQHLCGSHLVEALHLVCGDRGFFYTPK

SEQ ID NO: 25052 - protein, 30 aa, synthetic construct
KFVNQHLCGSHLVEALHLVCGDRGFFYTPK

SEQ ID NO: 25053 - protein, 26 aa, synthetic construct
KHLCGSHLVEALHLVCGDRGFFYTPK

SEQ ID NO: 25054 - protein, 31 aa, synthetic construct
KFVNQHLCGSHLVEALHLVCGKRGFHYTRPT

SEQ ID NO: 25055 - protein, 31 aa, synthetic construct
KFVGQHLCGSHLVEALHLVCGKRGFHYTRPT

SEQ ID NO: 25056 - protein, 27 aa, synthetic construct
KHLCGSHLVEALHLVCGKRGFHYTRPT

SEQ ID NO: 25057 - protein, 30 aa, synthetic construct
KFVNQHLCGSHLVEALHLVCGKRGFHYTRP

SEQ ID NO: 25058 - protein, 30 aa, synthetic construct
KFVGQHLCGSHLVEALHLVCGKRGFHYTRP

SEQ ID NO: 25059 - protein, 26 aa, synthetic construct
KHLCGSHLVEALHLVCGKRGFHYTRP

SEQ ID NO: 25060 - protein, 30 aa, synthetic construct
KFVSQHLCGSHLVEALHLVCGKRGFHYTPR

SEQ ID NO: 25061 - protein, 30 aa, synthetic construct
KFVTQHLCGSHLVEALHLVCGKRGFHYTPR

SEQ ID NO: 25062 - protein, 30 aa, synthetic construct
KFVGQHLCGSHLVEALHLVCGKRGFHYTPR

SEQ ID NO: 25063 - protein, 30 aa, synthetic construct
KFVNQHLCGSHLVEALHLVCGKRGFHYTPR

SEQ ID NO: 25064 - protein, 26 aa, synthetic construct
KHLCGSHLVEALHLVCGKRGFHYTPR

SEQ ID NO: 25065 - protein, 31 aa, synthetic construct
KFVNQHLCGSHLVEALHLVCGDRGFHYTKPT

SEQ ID NO: 25066 - protein, 31 aa, synthetic construct
KFVGQHLCGSHLVEALHLVCGDRGFHYTKPT

SEQ ID NO: 25067 - protein, 27 aa, synthetic construct
KHLCGSHLVEALHLVCGDRGFHYTKPT

SEQ ID NO: 25068 - protein, 30 aa, synthetic construct
KFVNQHLCGSHLVEALHLVCGDRGFHYTKP

SEQ ID NO: 25069 - protein, 30 aa, synthetic construct
KFVGQHLCGSHLVEALHLVCGDRGFHYTKP

SEQ ID NO: 25070 - protein, 26 aa, synthetic construct
KHLCGSHLVEALHLVCGDRGFHYTKP

SEQ ID NO: 25071 - protein, 30 aa, synthetic construct
KFVSQHLCGSHLVEALHLVCGDRGFHYTPK

SEQ ID NO: 25072 - protein, 30 aa, synthetic construct
KFVTQHLCGSHLVEALHLVCGDRGFHYTPK

SEQ ID NO: 25073 - protein, 30 aa, synthetic construct
KFVGQHLCGSHLVEALHLVCGDRGFHYTPK

SEQ ID NO: 25074 - protein, 30 aa, synthetic construct
KFVNQHLCGSHLVEALHLVCGDRGFHYTPK

SEQ ID NO: 25075 - protein, 26 aa, synthetic construct
KHLCGSHLVEALHLVCGDRGFHYTPK

SEQ ID NO: 25076 - protein, 49 aa, synthetic construct
KGSHGGGGSGGGGSGGGGSFVNQHLCGSHLVEALYLVCGKRGFFYTRPT

SEQ ID NO: 25077 - protein, 49 aa, synthetic construct
KGSHGGGGSGGGGSGGGGSFVGQHLCGSHLVEALYLVCGKRGFFYTRPT

SEQ ID NO: 25078 - protein, 45 aa, synthetic construct
KGSHGGGGSGGGGSGGGGSHLCGSHLVEALYLVCGKRGFFYTRPT

SEQ ID NO: 25079 - protein, 48 aa, synthetic construct
KGSHGGGGSGGGGSGGGGSFVNQHLCGSHLVEALYLVCGKRGFFYTRP

SEQ ID NO: 25080 - protein, 48 aa, synthetic construct
KGSHGGGGSGGGGSGGGGSFVGQHLCGSHLVEALYLVCGKRGFFYTRP

SEQ ID NO: 25081 - protein, 44 aa, synthetic construct
KGSHGGGGSGGGGSGGGGSHLCGSHLVEALYLVCGKRGFFYTRP

SEQ ID NO: 25082 - protein, 48 aa, synthetic construct
KGSHGGGGSGGGGSGGGGSFVSQHLCGSHLVEALYLVCGKRGFFYTPR

SEQ ID NO: 25083 - protein, 48 aa, synthetic construct
KGSHGGGGSGGGGSGGGGSFVTQHLCGSHLVEALYLVCGKRGFFYTPR

SEQ ID NO: 25084 - protein, 48 aa, synthetic construct
KGSHGGGGSGGGGSGGGGSFVGQHLCGSHLVEALYLVCGKRGFFYTPR

SEQ ID NO: 25085 - protein, 48 aa, synthetic construct
KGSHGGGGSGGGGSGGGGSFVNQHLCGSHLVEALYLVCGKRGFFYTPR

SEQ ID NO: 25086 - protein, 44 aa, synthetic construct
KGSHGGGGSGGGGSGGGGSHLCGSHLVEALYLVCGKRGFFYTPR

SEQ ID NO: 25087 - protein, 49 aa, synthetic construct
KGSHGGGGSGGGGSGGGGSFVNQHLCGSHLVEALYLVCGERGFFYTKPT

SEQ ID NO: 25088 - protein, 49 aa, synthetic construct
KGSHGGGGSGGGGSGGGGSFVGQHLCGSHLVEALYLVCGERGFFYTKPT

SEQ ID NO: 25089 - protein, 45 aa, synthetic construct
KGSHGGGGSGGGGSGGGGSHLCGSHLVEALYLVCGERGFFYTKPT

SEQ ID NO: 25090 - protein, 48 aa, synthetic construct
KGSHGGGGSGGGGSGGGGSFVNQHLCGSHLVEALYLVCGERGFFYTKP

SEQ ID NO: 25091 - protein, 48 aa, synthetic construct
KGSHGGGGSGGGGSGGGGSFVGQHLCGSHLVEALYLVCGERGFFYTKP

SEQ ID NO: 25092 - protein, 44 aa, synthetic construct
KGSHGGGGSGGGGSGGGGSHLCGSHLVEALYLVCGERGFFYTKP

SEQ ID NO: 25093 - protein, 48 aa, synthetic construct
KGSHGGGGSGGGGSGGGGSFVSQHLCGSHLVEALYLVCGERGFFYTPK

SEQ ID NO: 25094 - protein, 48 aa, synthetic construct
KGSHGGGGSGGGGSGGGGSFVTQHLCGSHLVEALYLVCGERGFFYTPK

SEQ ID NO: 25095 - protein, 48 aa, synthetic construct
KGSHGGGGSGGGGSGGGGSFVGQHLCGSHLVEALYLVCGERGFFYTPK

SEQ ID NO: 25096 - protein, 48 aa, synthetic construct
KGSHGGGGSGGGGSGGGGSFVNQHLCGSHLVEALYLVCGERGFFYTPK

SEQ ID NO: 25097 - protein, 44 aa, synthetic construct
KGSHGGGGSGGGGSGGGGSHLCGSHLVEALYLVCGERGFFYTPK

SEQ ID NO: 25098 - protein, 49 aa, synthetic construct
KGSHGGGGSGGGGSGGGGSFVNQHLCGSHLVEALYLVCGDRGFFYTKPT

SEQ ID NO: 25099 - protein, 49 aa, synthetic construct
KGSHGGGGSGGGGSGGGGSFVGQHLCGSHLVEALYLVCGDRGFFYTKPT

SEQ ID NO: 25100 - protein, 45 aa, synthetic construct
KGSHGGGGSGGGGSGGGGSHLCGSHLVEALYLVCGDRGFFYTKPT

SEQ ID NO: 25101 - protein, 48 aa, synthetic construct
KGSHGGGGSGGGGSGGGGSFVNQHLCGSHLVEALYLVCGDRGFFYTKP

SEQ ID NO: 25102 - protein, 48 aa, synthetic construct
KGSHGGGGSGGGGSGGGGSFVGQHLCGSHLVEALYLVCGDRGFFYTKP

SEQ ID NO: 25103 - protein, 44 aa, synthetic construct
KGSHGGGGSGGGGSGGGGSHLCGSHLVEALYLVCGDRGFFYTKP

SEQ ID NO: 25104 - protein, 48 aa, synthetic construct
KGSHGGGGSGGGGSGGGGSFVSQHLCGSHLVEALYLVCGDRGFFYTPK

SEQ ID NO: 25105 - protein, 48 aa, synthetic construct
KGSHGGGGSGGGGSGGGGSFVTQHLCGSHLVEALYLVCGDRGFFYTPK

SEQ ID NO: 25106 - protein, 48 aa, synthetic construct
KGSHGGGGSGGGGSGGGGSFVGQHLCGSHLVEALYLVCGDRGFFYTPK

SEQ ID NO: 25107 - protein, 48 aa, synthetic construct
KGSHGGGGSGGGGSGGGGSFVNQHLCGSHLVEALYLVCGDRGFFYTPK

SEQ ID NO: 25108 - protein, 44 aa, synthetic construct
KGSHGGGGSGGGGSGGGGSHLCGSHLVEALYLVCGDRGFFYTPK

SEQ ID NO: 25109 - protein, 49 aa, synthetic construct
KGSHGGGGSGGGGSGGGGSFVNQHLCGSHLVEALHLVCGKRGFFYTRPT

SEQ ID NO: 25110 - protein, 49 aa, synthetic construct
KGSHGGGGSGGGGSGGGGSFVGQHLCGSHLVEALHLVCGKRGFFYTRPT

SEQ ID NO: 25111 - protein, 45 aa, synthetic construct
KGSHGGGGSGGGGSGGGGSHLCGSHLVEALHLVCGKRGFFYTRPT

SEQ ID NO: 25112 - protein, 48 aa, synthetic construct
KGSHGGGGSGGGGSGGGGSFVNQHLCGSHLVEALHLVCGKRGFFYTRP

SEQ ID NO: 25113 - protein, 48 aa, synthetic construct
KGSHGGGGSGGGGSGGGGSFVGQHLCGSHLVEALHLVCGKRGFFYTRP

SEQ ID NO: 25114 - protein, 44 aa, synthetic construct
KGSHGGGGSGGGGSGGGGSHLCGSHLVEALHLVCGKRGFFYTRP

SEQ ID NO: 25115 - protein, 48 aa, synthetic construct
KGSHGGGGSGGGGSGGGGSFVSQHLCGSHLVEALHLVCGKRGFFYTPR

SEQ ID NO: 25116 - protein, 48 aa, synthetic construct
KGSHGGGGSGGGGSGGGGSFVTQHLCGSHLVEALHLVCGKRGFFYTPR

SEQ ID NO: 25117 - protein, 48 aa, synthetic construct
KGSHGGGGSGGGGSGGGGSFVGQHLCGSHLVEALHLVCGKRGFFYTPR

SEQ ID NO: 25118 - protein, 48 aa, synthetic construct
KGSHGGGGSGGGGSGGGGSFVNQHLCGSHLVEALHLVCGKRGFFYTPR

SEQ ID NO: 25119 - protein, 44 aa, synthetic construct
KGSHGGGGSGGGGSGGGGSHLCGSHLVEALHLVCGKRGFFYTPR

SEQ ID NO: 25120 - protein, 49 aa, synthetic construct
KGSHGGGGSGGGGSGGGGSFVGQHLCGSHLVEALHLVCGDRGFFYTKPT

SEQ ID NO: 25121 - protein, 45 aa, synthetic construct
KGSHGGGGSGGGGSGGGGSHLCGSHLVEALHLVCGDRGFFYTKPT

SEQ ID NO: 25122 - protein, 48 aa, synthetic construct
KGSHGGGGSGGGGSGGGGSFVNQHLCGSHLVEALHLVCGDRGFFYTKP

SEQ ID NO: 25123 - protein, 48 aa, synthetic construct
KGSHGGGGSGGGGSGGGGSFVGQHLCGSHLVEALHLVCGDRGFFYTKP

SEQ ID NO: 25124 - protein, 44 aa, synthetic construct
KGSHGGGGSGGGGSGGGGSHLCGSHLVEALHLVCGDRGFFYTKP

SEQ ID NO: 25125 - protein, 48 aa, synthetic construct
KGSHGGGGSGGGGSGGGGSFVSQHLCGSHLVEALHLVCGDRGFFYTPK

SEQ ID NO: 25126 - protein, 48 aa, synthetic construct
KGSHGGGGSGGGGSGGGGSFVTQHLCGSHLVEALHLVCGDRGFFYTPK

SEQ ID NO: 25127 - protein, 48 aa, synthetic construct
KGSHGGGGSGGGGSGGGGSFVGQHLCGSHLVEALHLVCGDRGFFYTPK

SEQ ID NO: 25128 - protein, 48 aa, synthetic construct
KGSHGGGGSGGGGSGGGGSFVNQHLCGSHLVEALHLVCGDRGFFYTPK

SEQ ID NO: 25129 - protein, 44 aa, synthetic construct
KGSHGGGGSGGGGSGGGGSHLCGSHLVEALHLVCGDRGFFYTPK

SEQ ID NO: 25130 - protein, 49 aa, synthetic construct
KGSHGGGGSGGGGSGGGGSFVNQHLCGSHLVEALHLVCGKRGFHYTRPT

SEQ ID NO: 25131 - protein, 49 aa, synthetic construct
KGSHGGGGSGGGGSGGGGSFVGQHLCGSHLVEALHLVCGKRGFHYTRPT

SEQ ID NO: 25132 - protein, 45 aa, synthetic construct
KGSHGGGGSGGGGSGGGGSHLCGSHLVEALHLVCGKRGFHYTRPT

SEQ ID NO: 25133 - protein, 48 aa, synthetic construct
KGSHGGGGSGGGGSGGGGSFVNQHLCGSHLVEALHLVCGKRGFHYTRP

SEQ ID NO: 25134 - protein, 48 aa, synthetic construct
KGSHGGGGSGGGGSGGGGSFVGQHLCGSHLVEALHLVCGKRGFHYTRP

SEQ ID NO: 25135 - protein, 44 aa, synthetic construct
KGSHGGGGSGGGGSGGGGSHLCGSHLVEALHLVCGKRGFHYTRP

SEQ ID NO: 25136 - protein, 48 aa, synthetic construct
KGSHGGGGSGGGGSGGGGSFVSQHLCGSHLVEALHLVCGKRGFHYTPR

SEQ ID NO: 25137 - protein, 48 aa, synthetic construct
KGSHGGGGSGGGGSGGGGSFVTQHLCGSHLVEALHLVCGKRGFHYTPR

SEQ ID NO: 25138 - protein, 48 aa, synthetic construct
KGSHGGGGSGGGGSGGGGSFVGQHLCGSHLVEALHLVCGKRGFHYTPR

SEQ ID NO: 25139 - protein, 48 aa, synthetic construct
KGSHGGGGSGGGGSGGGGSFVNQHLCGSHLVEALHLVCGKRGFHYTPR

SEQ ID NO: 25140 - protein, 44 aa, synthetic construct
KGSHGGGGSGGGGSGGGGSHLCGSHLVEALHLVCGKRGFHYTPR

SEQ ID NO: 25141 - protein, 49 aa, synthetic construct
KGSHGGGGSGGGGSGGGGSFVNQHLCGSHLVEALHLVCGDRGFHYTKPT

SEQ ID NO: 25142 - protein, 49 aa, synthetic construct
KGSHGGGGSGGGGSGGGGSFVGQHLCGSHLVEALHLVCGDRGFHYTKPT

SEQ ID NO: 25143 - protein, 45 aa, synthetic construct
KGSHGGGGSGGGGSGGGGSHLCGSHLVEALHLVCGDRGFHYTKPT

SEQ ID NO: 25144 - protein, 48 aa, synthetic construct
KGSHGGGGSGGGGSGGGGSFVNQHLCGSHLVEALHLVCGDRGFHYTKP

SEQ ID NO: 25145 - protein, 48 aa, synthetic construct
KGSHGGGGSGGGGSGGGGSFVGQHLCGSHLVEALHLVCGDRGFHYTKP

SEQ ID NO: 25146 - protein, 44 aa, synthetic construct
KGSHGGGGSGGGGSGGGGSHLCGSHLVEALHLVCGDRGFHYTKP

SEQ ID NO: 25147 - protein, 48 aa, synthetic construct
KGSHGGGGSGGGGSGGGGSFVSQHLCGSHLVEALHLVCGDRGFHYTPK

SEQ ID NO: 25148 - protein, 48 aa, synthetic construct
KGSHGGGGSGGGGSGGGGSFVTQHLCGSHLVEALHLVCGDRGFHYTPK

SEQ ID NO: 25149 - protein, 48 aa, synthetic construct
KGSHGGGGSGGGGSGGGGSFVGQHLCGSHLVEALHLVCGDRGFHYTPK

SEQ ID NO: 25150 - protein, 48 aa, synthetic construct
KGSHGGGGSGGGGSGGGGSFVNQHLCGSHLVEALHLVCGDRGFHYTPK

SEQ ID NO: 25151 - protein, 44 aa, synthetic construct
KGSHGGGGSGGGGSGGGGSHLCGSHLVEALHLVCGDRGFHYTPK

SEQ ID NO: 25152 - protein, 54 aa, synthetic construct
KGSHGGGGSGGGGSGGGGSGGGGSFVNQHLCGSHLVEALYLVCGKRGFFYTRPT

SEQ ID NO: 25153 - protein, 54 aa, synthetic construct
KGSHGGGGSGGGGSGGGGSGGGGSFVGQHLCGSHLVEALYLVCGKRGFFYTRPT

SEQ ID NO: 25154 - protein, 50 aa, synthetic construct
KGSHGGGGSGGGGSGGGGSGGGGSHLCGSHLVEALYLVCGKRGFFYTRPT

SEQ ID NO: 25155 - protein, 53 aa, synthetic construct
KGSHGGGGSGGGGSGGGGSGGGGSFVNQHLCGSHLVEALYLVCGKRGFFYTRP

SEQ ID NO: 25156 - protein, 53 aa, synthetic construct
KGSHGGGGSGGGGSGGGGSGGGGSFVGQHLCGSHLVEALYLVCGKRGFFYTRP

SEQ ID NO: 25157 - protein, 49 aa, synthetic construct
KGSHGGGGSGGGGSGGGGSGGGGSHLCGSHLVEALYLVCGKRGFFYTRP

SEQ ID NO: 25158 - protein, 53 aa, synthetic construct
KGSHGGGGSGGGGSGGGGSGGGGSFVSQHLCGSHLVEALYLVCGKRGFFYTPR

SEQ ID NO: 25159 - protein, 53 aa, synthetic construct
KGSHGGGGSGGGGSGGGGSGGGGSFVTQHLCGSHLVEALYLVCGKRGFFYTPR

SEQ ID NO: 25160 - protein, 53 aa, synthetic construct
KGSHGGGGSGGGGSGGGGSGGGGSFVGQHLCGSHLVEALYLVCGKRGFFYTPR

SEQ ID NO: 25161 - protein, 53 aa, synthetic construct
KGSHGGGGSGGGGSGGGGSGGGGSFVNQHLCGSHLVEALYLVCGKRGFFYTPR

SEQ ID NO: 25162 - protein, 49 aa, synthetic construct
KGSHGGGGSGGGGSGGGGSGGGGSHLCGSHLVEALYLVCGKRGFFYTPR

SEQ ID NO: 25163 - protein, 54 aa, synthetic construct
KGSHGGGGSGGGGSGGGGSGGGGSFVNQHLCGSHLVEALYLVCGERGFFYTKPT

SEQ ID NO: 25164 - protein, 54 aa, synthetic construct
KGSHGGGGSGGGGSGGGGSGGGGSFVGQHLCGSHLVEALYLVCGERGFFYTKPT

SEQ ID NO: 25165 - protein, 50 aa, synthetic construct
KGSHGGGGSGGGGSGGGGSGGGGSHLCGSHLVEALYLVCGERGFFYTKPT

SEQ ID NO: 25166 - protein, 53 aa, synthetic construct
KGSHGGGGSGGGGSGGGGSGGGGSFVNQHLCGSHLVEALYLVCGERGFFYTKP

SEQ ID NO: 25167 - protein, 53 aa, synthetic construct
KGSHGGGGSGGGGSGGGGSGGGGSFVGQHLCGSHLVEALYLVCGERGFFYTKP

SEQ ID NO: 25168 - protein, 49 aa, synthetic construct
KGSHGGGGSGGGGSGGGGSGGGGSHLCGSHLVEALYLVCGERGFFYTKP

SEQ ID NO: 25169 - protein, 53 aa, synthetic construct
KGSHGGGGSGGGGSGGGGSGGGGSFVSQHLCGSHLVEALYLVCGERGFFYTPK

SEQ ID NO: 25170 - protein, 53 aa, synthetic construct
KGSHGGGGSGGGGSGGGGSGGGGSFVTQHLCGSHLVEALYLVCGERGFFYTPK

SEQ ID NO: 25171 - protein, 53 aa, synthetic construct
KGSHGGGGSGGGGSGGGGSGGGGSFVGQHLCGSHLVEALYLVCGERGFFYTPK

SEQ ID NO: 25172 - protein, 53 aa, synthetic construct
KGSHGGGGSGGGGSGGGGSGGGGSFVNQHLCGSHLVEALYLVCGERGFFYTPK

SEQ ID NO: 25173 - protein, 49 aa, synthetic construct
KGSHGGGGSGGGGSGGGGSGGGGSHLCGSHLVEALYLVCGERGFFYTPK

SEQ ID NO: 25174 - protein, 54 aa, synthetic construct
KGSHGGGGSGGGGSGGGGSGGGGSFVNQHLCGSHLVEALYLVCGDRGFFYTKPT

SEQ ID NO: 25175 - protein, 54 aa, synthetic construct
KGSHGGGGSGGGGSGGGGSGGGGSFVGQHLCGSHLVEALYLVCGDRGFFYTKPT

SEQ ID NO: 25176 - protein, 50 aa, synthetic construct
KGSHGGGGSGGGGSGGGGSGGGGSHLCGSHLVEALYLVCGDRGFFYTKPT

SEQ ID NO: 25177 - protein, 53 aa, synthetic construct
KGSHGGGGSGGGGSGGGGSGGGGSFVNQHLCGSHLVEALYLVCGDRGFFYTKP

SEQ ID NO: 25178 - protein, 53 aa, synthetic construct
KGSHGGGGSGGGGSGGGGSGGGGSFVGQHLCGSHLVEALYLVCGDRGFFYTKP

SEQ ID NO: 25179 - protein, 49 aa, synthetic construct
KGSHGGGGSGGGGSGGGGSGGGGSHLCGSHLVEALYLVCGDRGFFYTKP

SEQ ID NO: 25180 - protein, 53 aa, synthetic construct
KGSHGGGGSGGGGSGGGGSGGGGSFVSQHLCGSHLVEALYLVCGDRGFFYTPK

SEQ ID NO: 25181 - protein, 53 aa, synthetic construct
KGSHGGGGSGGGGSGGGGSGGGGSFVTQHLCGSHLVEALYLVCGDRGFFYTPK

SEQ ID NO: 25182 - protein, 53 aa, synthetic construct
KGSHGGGGSGGGGSGGGGSGGGGSFVGQHLCGSHLVEALYLVCGDRGFFYTPK

SEQ ID NO: 25183 - protein, 53 aa, synthetic construct
KGSHGGGGSGGGGSGGGGSGGGGSFVNQHLCGSHLVEALYLVCGDRGFFYTPK

SEQ ID NO: 25184 - protein, 49 aa, synthetic construct
KGSHGGGGSGGGGSGGGGSGGGGSHLCGSHLVEALYLVCGDRGFFYTPK

SEQ ID NO: 25185 - protein, 54 aa, synthetic construct
KGSHGGGGSGGGGSGGGGSGGGGSFVNQHLCGSHLVEALHLVCGKRGFFYTRPT

SEQ ID NO: 25186 - protein, 54 aa, synthetic construct
KGSHGGGGSGGGGSGGGGSGGGGSFVGQHLCGSHLVEALHLVCGKRGFFYTRPT

SEQ ID NO: 25187 - protein, 50 aa, synthetic construct
KGSHGGGGSGGGGSGGGGSGGGGSHLCGSHLVEALHLVCGKRGFFYTRPT

SEQ ID NO: 25188 - protein, 53 aa, synthetic construct
KGSHGGGGSGGGGSGGGGSGGGGSFVNQHLCGSHLVEALHLVCGKRGFFYTRP

SEQ ID NO: 25189 - protein, 53 aa, synthetic construct
KGSHGGGGSGGGGSGGGGSGGGGSFVGQHLCGSHLVEALHLVCGKRGFFYTRP

SEQ ID NO: 25190 - protein, 49 aa, synthetic construct
KGSHGGGGSGGGGSGGGGSGGGGSHLCGSHLVEALHLVCGKRGFFYTRP

SEQ ID NO: 25191 - protein, 53 aa, synthetic construct
KGSHGGGGSGGGGSGGGGSGGGGSFVSQHLCGSHLVEALHLVCGKRGFFYTPR

SEQ ID NO: 25192 - protein, 53 aa, synthetic construct
KGSHGGGGSGGGGSGGGGSGGGGSFVTQHLCGSHLVEALHLVCGKRGFFYTPR

SEQ ID NO: 25193 - protein, 53 aa, synthetic construct
KGSHGGGGSGGGGSGGGGSGGGGSFVGQHLCGSHLVEALHLVCGKRGFFYTPR

SEQ ID NO: 25194 - protein, 53 aa, synthetic construct
KGSHGGGGSGGGGSGGGGSGGGGSFVNQHLCGSHLVEALHLVCGKRGFFYTPR

SEQ ID NO: 25195 - protein, 49 aa, synthetic construct
KGSHGGGGSGGGGSGGGGSGGGGSHLCGSHLVEALHLVCGKRGFFYTPR

SEQ ID NO: 25196 - protein, 54 aa, synthetic construct
KGSHGGGGSGGGGSGGGGSGGGGSFVGQHLCGSHLVEALHLVCGDRGFFYTKPT

SEQ ID NO: 25197 - protein, 50 aa, synthetic construct
KGSHGGGGSGGGGSGGGGSGGGGSHLCGSHLVEALHLVCGDRGFFYTKPT

SEQ ID NO: 25198 - protein, 53 aa, synthetic construct
KGSHGGGGSGGGGSGGGGSGGGGSFVNQHLCGSHLVEALHLVCGDRGFFYTKP

SEQ ID NO: 25199 - protein, 53 aa, synthetic construct
KGSHGGGGSGGGGSGGGGSGGGGSFVGQHLCGSHLVEALHLVCGDRGFFYTKP

SEQ ID NO: 25200 - protein, 49 aa, synthetic construct
KGSHGGGGSGGGGSGGGGSGGGGSHLCGSHLVEALHLVCGDRGFFYTKP

SEQ ID NO: 25201 - protein, 53 aa, synthetic construct
KGSHGGGGSGGGGSGGGGSGGGGSFVSQHLCGSHLVEALHLVCGDRGFFYTPK

SEQ ID NO: 25202 - protein, 53 aa, synthetic construct
KGSHGGGGSGGGGSGGGGSGGGGSFVTQHLCGSHLVEALHLVCGDRGFFYTPK

SEQ ID NO: 25203 - protein, 53 aa, synthetic construct
KGSHGGGGSGGGGSGGGGSGGGGSFVGQHLCGSHLVEALHLVCGDRGFFYTPK

SEQ ID NO: 25204 - protein, 53 aa, synthetic construct
KGSHGGGGSGGGGSGGGGSGGGGSFVNQHLCGSHLVEALHLVCGDRGFFYTPK

SEQ ID NO: 25205 - protein, 49 aa, synthetic construct
KGSHGGGGSGGGGSGGGGSGGGGSHLCGSHLVEALHLVCGDRGFFYTPK

SEQ ID NO: 25206 - protein, 54 aa, synthetic construct
KGSHGGGGSGGGGSGGGGSGGGGSFVNQHLCGSHLVEALHLVCGKRGFHYTRPT

SEQ ID NO: 25207 - protein, 54 aa, synthetic construct
KGSHGGGGSGGGGSGGGGSGGGGSFVGQHLCGSHLVEALHLVCGKRGFHYTRPT

SEQ ID NO: 25208 - protein, 50 aa, synthetic construct
KGSHGGGGSGGGGSGGGGSGGGGSHLCGSHLVEALHLVCGKRGFHYTRPT

SEQ ID NO: 25209 - protein, 53 aa, synthetic construct
KGSHGGGGSGGGGSGGGGSGGGGSFVNQHLCGSHLVEALHLVCGKRGFHYTRP

SEQ ID NO: 25210 - protein, 53 aa, synthetic construct
KGSHGGGGSGGGGSGGGGSGGGGSFVGQHLCGSHLVEALHLVCGKRGFHYTRP

SEQ ID NO: 25211 - protein, 49 aa, synthetic construct
KGSHGGGGSGGGGSGGGGSGGGGSHLCGSHLVEALHLVCGKRGFHYTRP

SEQ ID NO: 25212 - protein, 53 aa, synthetic construct
KGSHGGGGSGGGGSGGGGSGGGGSFVSQHLCGSHLVEALHLVCGKRGFHYTPR

SEQ ID NO: 25213 - protein, 53 aa, synthetic construct
KGSHGGGGSGGGGSGGGGSGGGGSFVTQHLCGSHLVEALHLVCGKRGFHYTPR

SEQ ID NO: 25214 - protein, 53 aa, synthetic construct
KGSHGGGGSGGGGSGGGGSGGGGSFVGQHLCGSHLVEALHLVCGKRGFHYTPR

SEQ ID NO: 25215 - protein, 53 aa, synthetic construct
KGSHGGGGSGGGGSGGGGSGGGGSFVNQHLCGSHLVEALHLVCGKRGFHYTPR

SEQ ID NO: 25216 - protein, 49 aa, synthetic construct
KGSHGGGGSGGGGSGGGGSGGGGSHLCGSHLVEALHLVCGKRGFHYTPR

SEQ ID NO: 25217 - protein, 54 aa, synthetic construct
KGSHGGGGSGGGGSGGGGSGGGGSFVNQHLCGSHLVEALHLVCGDRGFHYTKPT

SEQ ID NO: 25218 - protein, 54 aa, synthetic construct
KGSHGGGGSGGGGSGGGGSGGGGSFVGQHLCGSHLVEALHLVCGDRGFHYTKPT

SEQ ID NO: 25219 - protein, 50 aa, synthetic construct
KGSHGGGGSGGGGSGGGGSGGGGSHLCGSHLVEALHLVCGDRGFHYTKPT

SEQ ID NO: 25220 - protein, 53 aa, synthetic construct
KGSHGGGGSGGGGSGGGGSGGGGSFVNQHLCGSHLVEALHLVCGDRGFHYTKP

SEQ ID NO: 25221 - protein, 53 aa, synthetic construct
KGSHGGGGSGGGGSGGGGSGGGGSFVGQHLCGSHLVEALHLVCGDRGFHYTKP

SEQ ID NO: 25222 - protein, 49 aa, synthetic construct
KGSHGGGGSGGGGSGGGGSGGGGSHLCGSHLVEALHLVCGDRGFHYTKP

SEQ ID NO: 25223 - protein, 53 aa, synthetic construct
KGSHGGGGSGGGGSGGGGSGGGGSFVSQHLCGSHLVEALHLVCGDRGFHYTPK

SEQ ID NO: 25224 - protein, 53 aa, synthetic construct
KGSHGGGGSGGGGSGGGGSGGGGSFVTQHLCGSHLVEALHLVCGDRGFHYTPK

SEQ ID NO: 25225 - protein, 53 aa, synthetic construct
KGSHGGGGSGGGGSGGGGSGGGGSFVGQHLCGSHLVEALHLVCGDRGFHYTPK

SEQ ID NO: 25226 - protein, 53 aa, synthetic construct
KGSHGGGGSGGGGSGGGGSGGGGSFVNQHLCGSHLVEALHLVCGDRGFHYTPK

SEQ ID NO: 25227 - protein, 49 aa, synthetic construct
KGSHGGGGSGGGGSGGGGSGGGGSHLCGSHLVEALHLVCGDRGFHYTPK

SEQ ID NO: 25228 - protein, 35 aa, synthetic construct
GKGSHKFVNQHLCGSHLVEALYLVCGKRGFFYTPR

SEQ ID NO: 25229 - protein, 36 aa, synthetic construct
GKGSHKFVGQHLCGSHLVEALYLVCGKRGFFYTRPT

SEQ ID NO: 25230 - protein, 32 aa, synthetic construct
GKGSHKHLCGSHLVEALYLVCGKRGFFYTRPT

SEQ ID NO: 25231 - protein, 35 aa, synthetic construct
GKGSHKFVNQHLCGSHLVEALYLVCGKRGFFYTRP

SEQ ID NO: 25232 - protein, 35 aa, synthetic construct
GKGSHKFVGQHLCGSHLVEALYLVCGKRGFFYTRP

SEQ ID NO: 25233 - protein, 31 aa, synthetic construct
GKGSHKHLCGSHLVEALYLVCGKRGFFYTRP

SEQ ID NO: 25234 - protein, 35 aa, synthetic construct
GKGSHKFVSQHLCGSHLVEALYLVCGKRGFFYTPR

SEQ ID NO: 25235 - protein, 35 aa, synthetic construct
GKGSHKFVTQHLCGSHLVEALYLVCGKRGFFYTPR

SEQ ID NO: 25236 - protein, 35 aa, synthetic construct
GKGSHKFVGQHLCGSHLVEALYLVCGKRGFFYTPR

SEQ ID NO: 25237 - protein, 36 aa, synthetic construct
GKGSHKFVNQHLCGSHLVEALYLVCGKRGFFYTPRT

SEQ ID NO: 25238 - protein, 31 aa, synthetic construct
GKGSHKHLCGSHLVEALYLVCGKRGFFYTPR

SEQ ID NO: 25239 - protein, 36 aa, synthetic construct
GKGSHKFVNQHLCGSHLVEALYLVCGERGFFYTKPT

SEQ ID NO: 25240 - protein, 36 aa, synthetic construct
GKGSHKFVGQHLCGSHLVEALYLVCGERGFFYTKPT

SEQ ID NO: 25241 - protein, 32 aa, synthetic construct
GKGSHKHLCGSHLVEALYLVCGERGFFYTKPT

SEQ ID NO: 25242 - protein, 35 aa, synthetic construct
GKGSHKFVNQHLCGSHLVEALYLVCGERGFFYTKP

SEQ ID NO: 25243 - protein, 35 aa, synthetic construct
GKGSHKFVGQHLCGSHLVEALYLVCGERGFFYTKP

SEQ ID NO: 25244 - protein, 31 aa, synthetic construct
GKGSHKHLCGSHLVEALYLVCGERGFFYTKP

SEQ ID NO: 25245 - protein, 35 aa, synthetic construct
GKGSHKFVSQHLCGSHLVEALYLVCGERGFFYTPK

SEQ ID NO: 25246 - protein, 35 aa, synthetic construct
GKGSHKFVTQHLCGSHLVEALYLVCGERGFFYTPK

SEQ ID NO: 25247 - protein, 35 aa, synthetic construct
GKGSHKFVGQHLCGSHLVEALYLVCGERGFFYTPK

SEQ ID NO: 25248 - protein, 35 aa, synthetic construct
GKGSHKFVNQHLCGSHLVEALYLVCGERGFFYTPK

SEQ ID NO: 25249 - protein, 31 aa, synthetic construct
GKGSHKHLCGSHLVEALYLVCGERGFFYTPK

SEQ ID NO: 25250 - protein, 36 aa, synthetic construct
GKGSHKFVNQHLCGSHLVEALYLVCGDRGFFYTKPT

SEQ ID NO: 25251 - protein, 36 aa, synthetic construct
GKGSHKFVGQHLCGSHLVEALYLVCGDRGFFYTKPT

SEQ ID NO: 25252 - protein, 32 aa, synthetic construct
GKGSHKHLCGSHLVEALYLVCGDRGFFYTKPT

SEQ ID NO: 25253 - protein, 35 aa, synthetic construct
GKGSHKFVNQHLCGSHLVEALYLVCGDRGFFYTKP

SEQ ID NO: 25254 - protein, 35 aa, synthetic construct
GKGSHKFVGQHLCGSHLVEALYLVCGDRGFFYTKP

SEQ ID NO: 25255 - protein, 31 aa, synthetic construct
GKGSHKHLCGSHLVEALYLVCGDRGFFYTKP

SEQ ID NO: 25256 - protein, 35 aa, synthetic construct
GKGSHKFVSQHLCGSHLVEALYLVCGDRGFFYTPK

SEQ ID NO: 25257 - protein, 35 aa, synthetic construct
GKGSHKFVTQHLCGSHLVEALYLVCGDRGFFYTPK

SEQ ID NO: 25258 - protein, 35 aa, synthetic construct
GKGSHKFVGQHLCGSHLVEALYLVCGDRGFFYTPK

SEQ ID NO: 25259 - protein, 35 aa, synthetic construct
GKGSHKFVNQHLCGSHLVEALYLVCGDRGFFYTPK

SEQ ID NO: 25260 - protein, 31 aa, synthetic construct
GKGSHKHLCGSHLVEALYLVCGDRGFFYTPK

SEQ ID NO: 25261 - protein, 36 aa, synthetic construct
GKGSHKFVNQHLCGSHLVEALHLVCGKRGFFYTRPT

SEQ ID NO: 25262 - protein, 36 aa, synthetic construct
GKGSHKFVGQHLCGSHLVEALHLVCGKRGFFYTRPT

SEQ ID NO: 25263 - protein, 32 aa, synthetic construct
GKGSHKHLCGSHLVEALHLVCGKRGFFYTRPT

SEQ ID NO: 25264 - protein, 35 aa, synthetic construct
GKGSHKFVNQHLCGSHLVEALHLVCGKRGFFYTRP

SEQ ID NO: 25265 - protein, 35 aa, synthetic construct
GKGSHKFVGQHLCGSHLVEALHLVCGKRGFFYTRP

SEQ ID NO: 25266 - protein, 31 aa, synthetic construct
GKGSHKHLCGSHLVEALHLVCGKRGFFYTRP

SEQ ID NO: 25267 - protein, 35 aa, synthetic construct
GKGSHKFVSQHLCGSHLVEALHLVCGKRGFFYTPR

SEQ ID NO: 25268 - protein, 35 aa, synthetic construct
GKGSHKFVTQHLCGSHLVEALHLVCGKRGFFYTPR

SEQ ID NO: 25269 - protein, 35 aa, synthetic construct
GKGSHKFVGQHLCGSHLVEALHLVCGKRGFFYTPR

SEQ ID NO: 25270 - protein, 35 aa, synthetic construct
GKGSHKFVNQHLCGSHLVEALHLVCGKRGFFYTPR

SEQ ID NO: 25271 - protein, 31 aa, synthetic construct
GKGSHKHLCGSHLVEALHLVCGKRGFFYTPR

SEQ ID NO: 25272 - protein, 36 aa, synthetic construct
GKGSHKFVGQHLCGSHLVEALHLVCGDRGFFYTKPT

SEQ ID NO: 25273 - protein, 32 aa, synthetic construct
GKGSHKHLCGSHLVEALHLVCGDRGFFYTKPT

SEQ ID NO: 25274 - protein, 35 aa, synthetic construct
GKGSHKFVNQHLCGSHLVEALHLVCGDRGFFYTKP

SEQ ID NO: 25275 - protein, 35 aa, synthetic construct
GKGSHKFVGQHLCGSHLVEALHLVCGDRGFFYTKP

SEQ ID NO: 25276 - protein, 31 aa, synthetic construct
GKGSHKHLCGSHLVEALHLVCGDRGFFYTKP

SEQ ID NO: 25277 - protein, 35 aa, synthetic construct
GKGSHKFVSQHLCGSHLVEALHLVCGDRGFFYTPK

SEQ ID NO: 25278 - protein, 35 aa, synthetic construct
GKGSHKFVTQHLCGSHLVEALHLVCGDRGFFYTPK

SEQ ID NO: 25279 - protein, 35 aa, synthetic construct
GKGSHKFVGQHLCGSHLVEALHLVCGDRGFFYTPK

SEQ ID NO: 25280 - protein, 35 aa, synthetic construct
GKGSHKFVNQHLCGSHLVEALHLVCGDRGFFYTPK

SEQ ID NO: 25281 - protein, 31 aa, synthetic construct
GKGSHKHLCGSHLVEALHLVCGDRGFFYTPK

SEQ ID NO: 25282 - protein, 36 aa, synthetic construct
GKGSHKFVNQHLCGSHLVEALHLVCGKRGFHYTRPT

SEQ ID NO: 25283 - protein, 36 aa, synthetic construct
GKGSHKFVGQHLCGSHLVEALHLVCGKRGFHYTRPT

SEQ ID NO: 25284 - protein, 32 aa, synthetic construct
GKGSHKHLCGSHLVEALHLVCGKRGFHYTRPT

SEQ ID NO: 25285 - protein, 35 aa, synthetic construct
GKGSHKFVNQHLCGSHLVEALHLVCGKRGFHYTRP

SEQ ID NO: 25286 - protein, 35 aa, synthetic construct
GKGSHKFVGQHLCGSHLVEALHLVCGKRGFHYTRP

SEQ ID NO: 25287 - protein, 31 aa, synthetic construct
GKGSHKHLCGSHLVEALHLVCGKRGFHYTRP

SEQ ID NO: 25288 - protein, 35 aa, synthetic construct
GKGSHKFVSQHLCGSHLVEALHLVCGKRGFHYTPR

SEQ ID NO: 25289 - protein, 35 aa, synthetic construct
GKGSHKFVTQHLCGSHLVEALHLVCGKRGFHYTPR

SEQ ID NO: 25290 - protein, 35 aa, synthetic construct
GKGSHKFVGQHLCGSHLVEALHLVCGKRGFHYTPR

SEQ ID NO: 25291 - protein, 35 aa, synthetic construct
GKGSHKFVNQHLCGSHLVEALHLVCGKRGFHYTPR

SEQ ID NO: 25292 - protein, 31 aa, synthetic construct
GKGSHKHLCGSHLVEALHLVCGKRGFHYTPR

SEQ ID NO: 25293 - protein, 36 aa, synthetic construct
GKGSHKFVNQHLCGSHLVEALHLVCGDRGFHYTKPT

SEQ ID NO: 25294 - protein, 36 aa, synthetic construct
GKGSHKFVGQHLCGSHLVEALHLVCGDRGFHYTKPT

SEQ ID NO: 25295 - protein, 32 aa, synthetic construct
GKGSHKHLCGSHLVEALHLVCGDRGFHYTKPT

SEQ ID NO: 25296 - protein, 35 aa, synthetic construct
GKGSHKFVNQHLCGSHLVEALHLVCGDRGFHYTKP

SEQ ID NO: 25297 - protein, 35 aa, synthetic construct
GKGSHKFVGQHLCGSHLVEALHLVCGDRGFHYTKP

SEQ ID NO: 25298 - protein, 31 aa, synthetic construct
GKGSHKHLCGSHLVEALHLVCGDRGFHYTKP

SEQ ID NO: 25299 - protein, 35 aa, synthetic construct
GKGSHKFVSQHLCGSHLVEALHLVCGDRGFHYTPK

SEQ ID NO: 25300 - protein, 35 aa, synthetic construct
GKGSHKFVTQHLCGSHLVEALHLVCGDRGFHYTPK

SEQ ID NO: 25301 - protein, 35 aa, synthetic construct
GKGSHKFVGQHLCGSHLVEALHLVCGDRGFHYTPK

SEQ ID NO: 25302 - protein, 35 aa, synthetic construct
GKGSHKFVNQHLCGSHLVEALHLVCGDRGFHYTPK

SEQ ID NO: 25303 - protein, 31 aa, synthetic construct
GKGSHKHLCGSHLVEALHLVCGDRGFHYTPK

SEQ ID NO: 25304 - protein, 35 aa, synthetic construct
KGSHKFVNQHLCGSHLVEALYLVCGKRGFFYTRPT

SEQ ID NO: 25305 - protein, 35 aa, synthetic construct
KGSHKFVGQHLCGSHLVEALYLVCGKRGFFYTRPT

SEQ ID NO: 25306 - protein, 31 aa, synthetic construct
KGSHKHLCGSHLVEALYLVCGKRGFFYTRPT

SEQ ID NO: 25307 - protein, 34 aa, synthetic construct
KGSHKFVNQHLCGSHLVEALYLVCGKRGFFYTRP

SEQ ID NO: 25308 - protein, 34 aa, synthetic construct
KGSHKFVGQHLCGSHLVEALYLVCGKRGFFYTRP

SEQ ID NO: 25309 - protein, 30 aa, synthetic construct
KGSHKHLCGSHLVEALYLVCGKRGFFYTRP

SEQ ID NO: 25310 - protein, 34 aa, synthetic construct
KGSHKFVSQHLCGSHLVEALYLVCGKRGFFYTPR

SEQ ID NO: 25311 - protein, 34 aa, synthetic construct
KGSHKFVTQHLCGSHLVEALYLVCGKRGFFYTPR

SEQ ID NO: 25312 - protein, 34 aa, synthetic construct
KGSHKFVGQHLCGSHLVEALYLVCGKRGFFYTPR

SEQ ID NO: 25313 - protein, 34 aa, synthetic construct
KGSHKFVNQHLCGSHLVEALYLVCGKRGFFYTPR

SEQ ID NO: 25314 - protein, 30 aa, synthetic construct
KGSHKHLCGSHLVEALYLVCGKRGFFYTPR

SEQ ID NO: 25315 - protein, 35 aa, synthetic construct
KGSHKFVNQHLCGSHLVEALYLVCGERGFFYTKPT

SEQ ID NO: 25316 - protein, 35 aa, synthetic construct
KGSHKFVGQHLCGSHLVEALYLVCGERGFFYTKPT

SEQ ID NO: 25317 - protein, 31 aa, synthetic construct
KGSHKHLCGSHLVEALYLVCGERGFFYTKPT

SEQ ID NO: 25318 - protein, 34 aa, synthetic construct
KGSHKFVNQHLCGSHLVEALYLVCGERGFFYTKP

SEQ ID NO: 25319 - protein, 34 aa, synthetic construct
KGSHKFVGQHLCGSHLVEALYLVCGERGFFYTKP

SEQ ID NO: 25320 - protein, 30 aa, synthetic construct
KGSHKHLCGSHLVEALYLVCGERGFFYTKP

SEQ ID NO: 25321 - protein, 34 aa, synthetic construct
KGSHKFVSQHLCGSHLVEALYLVCGERGFFYTPK

SEQ ID NO: 25322 - protein, 34 aa, synthetic construct
KGSHKFVTQHLCGSHLVEALYLVCGERGFFYTPK

SEQ ID NO: 25323 - protein, 34 aa, synthetic construct
KGSHKFVGQHLCGSHLVEALYLVCGERGFFYTPK

SEQ ID NO: 25324 - protein, 34 aa, synthetic construct
KGSHKFVNQHLCGSHLVEALYLVCGERGFFYTPK

SEQ ID NO: 25325 - protein, 30 aa, synthetic construct
KGSHKHLCGSHLVEALYLVCGERGFFYTPK

SEQ ID NO: 25326 - protein, 35 aa, synthetic construct
KGSHKFVNQHLCGSHLVEALYLVCGDRGFFYTKPT

SEQ ID NO: 25327 - protein, 35 aa, synthetic construct
KGSHKFVGQHLCGSHLVEALYLVCGDRGFFYTKPT

SEQ ID NO: 25328 - protein, 31 aa, synthetic construct
KGSHKHLCGSHLVEALYLVCGDRGFFYTKPT

SEQ ID NO: 25329 - protein, 34 aa, synthetic construct
KGSHKFVNQHLCGSHLVEALYLVCGDRGFFYTKP

SEQ ID NO: 25330 - protein, 34 aa, synthetic construct
KGSHKFVGQHLCGSHLVEALYLVCGDRGFFYTKP

SEQ ID NO: 25331 - protein, 30 aa, synthetic construct
KGSHKHLCGSHLVEALYLVCGDRGFFYTKP

SEQ ID NO: 25332 - protein, 34 aa, synthetic construct
KGSHKFVSQHLCGSHLVEALYLVCGDRGFFYTPK

SEQ ID NO: 25333 - protein, 34 aa, synthetic construct
KGSHKFVTQHLCGSHLVEALYLVCGDRGFFYTPK

SEQ ID NO: 25334 - protein, 34 aa, synthetic construct
KGSHKFVGQHLCGSHLVEALYLVCGDRGFFYTPK

SEQ ID NO: 25335 - protein, 34 aa, synthetic construct
KGSHKFVNQHLCGSHLVEALYLVCGDRGFFYTPK

SEQ ID NO: 25336 - protein, 30 aa, synthetic construct
KGSHKHLCGSHLVEALYLVCGDRGFFYTPK

SEQ ID NO: 25337 - protein, 35 aa, synthetic construct
KGSHKFVNQHLCGSHLVEALHLVCGKRGFFYTRPT

SEQ ID NO: 25338 - protein, 35 aa, synthetic construct
KGSHKFVGQHLCGSHLVEALHLVCGKRGFFYTRPT

SEQ ID NO: 25339 - protein, 31 aa, synthetic construct
KGSHKHLCGSHLVEALHLVCGKRGFFYTRPT

SEQ ID NO: 25340 - protein, 34 aa, synthetic construct
KGSHKFVNQHLCGSHLVEALHLVCGKRGFFYTRP

SEQ ID NO: 25341 - protein, 34 aa, synthetic construct
KGSHKFVGQHLCGSHLVEALHLVCGKRGFFYTRP

SEQ ID NO: 25342 - protein, 30 aa, synthetic construct
KGSHKHLCGSHLVEALHLVCGKRGFFYTRP

SEQ ID NO: 25343 - protein, 34 aa, synthetic construct
KGSHKFVSQHLCGSHLVEALHLVCGKRGFFYTPR

SEQ ID NO: 25344 - protein, 34 aa, synthetic construct
KGSHKFVTQHLCGSHLVEALHLVCGKRGFFYTPR

SEQ ID NO: 25345 - protein, 34 aa, synthetic construct
KGSHKFVGQHLCGSHLVEALHLVCGKRGFFYTPR

SEQ ID NO: 25346 - protein, 34 aa, synthetic construct
KGSHKFVNQHLCGSHLVEALHLVCGKRGFFYTPR

SEQ ID NO: 25347 - protein, 30 aa, synthetic construct
KGSHKHLCGSHLVEALHLVCGKRGFFYTPR

SEQ ID NO: 25348 - protein, 35 aa, synthetic construct
KGSHKFVGQHLCGSHLVEALHLVCGDRGFFYTKPT

SEQ ID NO: 25349 - protein, 31 aa, synthetic construct
KGSHKHLCGSHLVEALHLVCGDRGFFYTKPT

SEQ ID NO: 25350 - protein, 34 aa, synthetic construct
KGSHKFVNQHLCGSHLVEALHLVCGDRGFFYTKP

SEQ ID NO: 25351 - protein, 34 aa, synthetic construct
KGSHKFVGQHLCGSHLVEALHLVCGDRGFFYTKP

SEQ ID NO: 25352 - protein, 30 aa, synthetic construct
KGSHKHLCGSHLVEALHLVCGDRGFFYTKP

SEQ ID NO: 25353 - protein, 34 aa, synthetic construct
KGSHKFVSQHLCGSHLVEALHLVCGDRGFFYTPK

SEQ ID NO: 25354 - protein, 34 aa, synthetic construct
KGSHKFVTQHLCGSHLVEALHLVCGDRGFFYTPK

SEQ ID NO: 25355 - protein, 34 aa, synthetic construct
KGSHKFVGQHLCGSHLVEALHLVCGDRGFFYTPK

SEQ ID NO: 25356 - protein, 34 aa, synthetic construct
KGSHKFVNQHLCGSHLVEALHLVCGDRGFFYTPK

SEQ ID NO: 25357 - protein, 30 aa, synthetic construct
KGSHKHLCGSHLVEALHLVCGDRGFFYTPK

SEQ ID NO: 25358 - protein, 35 aa, synthetic construct
KGSHKFVNQHLCGSHLVEALHLVCGKRGFHYTRPT

SEQ ID NO: 25359 - protein, 35 aa, synthetic construct
KGSHKFVGQHLCGSHLVEALHLVCGKRGFHYTRPT

SEQ ID NO: 25360 - protein, 31 aa, synthetic construct
KGSHKHLCGSHLVEALHLVCGKRGFHYTRPT

SEQ ID NO: 25361 - protein, 34 aa, synthetic construct
KGSHKFVNQHLCGSHLVEALHLVCGKRGFHYTRP

SEQ ID NO: 25362 - protein, 34 aa, synthetic construct
KGSHKFVGQHLCGSHLVEALHLVCGKRGFHYTRP

SEQ ID NO: 25363 - protein, 30 aa, synthetic construct
KGSHKHLCGSHLVEALHLVCGKRGFHYTRP

SEQ ID NO: 25364 - protein, 34 aa, synthetic construct
KGSHKFVSQHLCGSHLVEALHLVCGKRGFHYTPR

SEQ ID NO: 25365 - protein, 34 aa, synthetic construct
KGSHKFVTQHLCGSHLVEALHLVCGKRGFHYTPR

SEQ ID NO: 25366 - protein, 34 aa, synthetic construct
KGSHKFVGQHLCGSHLVEALHLVCGKRGFHYTPR

SEQ ID NO: 25367 - protein, 34 aa, synthetic construct
KGSHKFVNQHLCGSHLVEALHLVCGKRGFHYTPR

SEQ ID NO: 25368 - protein, 30 aa, synthetic construct
KGSHKHLCGSHLVEALHLVCGKRGFHYTPR

SEQ ID NO: 25369 - protein, 35 aa, synthetic construct
KGSHKFVNQHLCGSHLVEALHLVCGDRGFHYTKPT

SEQ ID NO: 25370 - protein, 35 aa, synthetic construct
KGSHKFVGQHLCGSHLVEALHLVCGDRGFHYTKPT

SEQ ID NO: 25371 - protein, 31 aa, synthetic construct
KGSHKHLCGSHLVEALHLVCGDRGFHYTKPT

SEQ ID NO: 25372 - protein, 34 aa, synthetic construct
KGSHKFVNQHLCGSHLVEALHLVCGDRGFHYTKP

SEQ ID NO: 25373 - protein, 34 aa, synthetic construct
KGSHKFVGQHLCGSHLVEALHLVCGDRGFHYTKP

SEQ ID NO: 25374 - protein, 30 aa, synthetic construct
KGSHKHLCGSHLVEALHLVCGDRGFHYTKP

SEQ ID NO: 25375 - protein, 34 aa, synthetic construct
KGSHKFVSQHLCGSHLVEALHLVCGDRGFHYTPK

SEQ ID NO: 25376 - protein, 34 aa, synthetic construct
KGSHKFVTQHLCGSHLVEALHLVCGDRGFHYTPK

SEQ ID NO: 25377 - protein, 34 aa, synthetic construct
KGSHKFVGQHLCGSHLVEALHLVCGDRGFHYTPK

SEQ ID NO: 25378 - protein, 34 aa, synthetic construct
KGSHKFVNQHLCGSHLVEALHLVCGDRGFHYTPK

SEQ ID NO: 25379 - protein, 30 aa, synthetic construct
KGSHKHLCGSHLVEALHLVCGDRGFHYTPK

SEQ ID NO: 25380 - protein, 35 aa, synthetic construct
KGSHKFVGQHLCGSHLVEALYLVCGKRGFFYTPRT

SEQ ID NO: 25381 - protein, 36 aa, synthetic construct
GKGSHKFVGQHLCGSHLVEALYLVCGKRGFFYTPRT

SEQ ID NO: 25382 - protein, 45 aa, synthetic construct
KGGGGSGGGGSGGGGSFVGQHLCGSHLVEALYLVCGERGFFYTPK

SEQ ID NO: 25383 - protein, 46 aa, synthetic construct
GKGGGGSGGGGSGGGGSFVGQHLCGSHLVEALYLVCGERGFFYTPK

SEQ ID NO: 25384 - protein, 46 aa, synthetic construct
KGGGGSGGGGSGGGGSFVGQHLCGSHLVEALYLVCGERGFFYTPKT

SEQ ID NO: 25385 - protein, 47 aa, synthetic construct
GKGGGGSGGGGSGGGGSFVGQHLCGSHLVEALYLVCGERGFFYTPKT

SEQ ID NO: 25386 - protein, 49 aa, synthetic construct
KGSHGGGGSGGGGSGGGGSFVGQHLCGSHLVEALYLVCGERGFFYTPKT

SEQ ID NO: 25387 - protein, 49 aa, synthetic construct
GKGSHGGGGSGGGGSGGGGSFVGQHLCGSHLVEALYLVCGERGFFYTPK

SEQ ID NO: 25388 - protein, 50 aa, synthetic construct
GKGSHGGGGSGGGGSGGGGSFVGQHLCGSHLVEALYLVCGERGFFYTPKT

SEQ ID NO: 25389 - protein, 45 aa, synthetic construct
KGGGGSGGGGSGGGGSFVGQHLCGSHLVEALYLVCGKRGFFYTPR

SEQ ID NO: 25390 - protein, 46 aa, synthetic construct
GKGGGGSGGGGSGGGGSFVGQHLCGSHLVEALYLVCGKRGFFYTPR

SEQ ID NO: 25391 - protein, 46 aa, synthetic construct
KGGGGSGGGGSGGGGSFVGQHLCGSHLVEALYLVCGKRGFFYTPRT

SEQ ID NO: 25392 - protein, 47 aa, synthetic construct
GKGGGGSGGGGSGGGGSFVGQHLCGSHLVEALYLVCGKRGFFYTPRT

SEQ ID NO: 25393 - protein, 34 aa, synthetic construct
KGSHKFVDQHLCGSHLVEALYLVCGKRGFFYTPR

SEQ ID NO: 25394 - protein, 31 aa, synthetic construct
KFVDQHLCGSHLVEALYLVCGKRGFFYTPKT

SEQ ID NO: 25395 - protein, 45 aa, synthetic construct
KGGGGSGGGGSGGGGSFVNQHLCGSHLVEALYLVCGERGFFYTPK

SEQ ID NO: 25396 - protein, 36 aa, synthetic construct
GKGSHKFVNQHLCGSHLVEALYLVCGKRGFFYTRPT

SEQ ID NO: 25397 - protein, 46 aa, synthetic construct
GKGGGGSGGGGSGGGGSFVNQHLCGSHLVEALYLVCGERGFFYTPK

SEQ ID NO: 25398 - protein, 21 aa, synthetic construct
  DISULFID 6..11: note = Intrachain disulfide bond
  DISULFID 7: note = Interchain disulfide bond with the cysteine at position 11 of SEQ ID NO: 25399
  DISULFID 20: note = Interchain disulfide bond with the cysteine at position 23 of SEQ ID NO: 25399
GIVEQCCTSICSLYQLENYCG

SEQ ID NO: 25399 - protein, 33 aa, synthetic construct; identical to SEQ ID NO: 24061
  SITE 1: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 25: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 11: note = Interchain disulfide bond with the cysteine at position 7 of SEQ ID NO: 25398
  DISULFID 23: note = Interchain disulfide bond with the cysteine at position 20 of SEQ ID NO: 25398

SEQ ID NO: 25400 - protein, 21 aa, synthetic construct
  DISULFID 6..11: note = Intrachain disulfide bond
  DISULFID 7: note = Interchain disulfide bond with the cysteine at position 25 of SEQ ID NO: 25401
  DISULFID 20: note = Interchain disulfide bond with the cysteine at position 37 of SEQ ID NO: 25401
GIVEQCCTSICSLYQLENYCN

SEQ ID NO: 25401 - protein, 47 aa, synthetic construct; identical to SEQ ID NO: 24064
  SITE 2: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  SITE 47: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  DISULFID 25: note = Interchain disulfide bond with the cysteine at position 7 of SEQ ID NO: 25400
  DISULFID 37: note = Interchain disulfide bond with the cysteine at position 20 of SEQ ID NO: 25400

SEQ ID NO: 25402 - protein, 22 aa, synthetic construct
  SITE 22: note 3-((2S,3S)-2,3-bis(1-hydroxy-1,3-dihydrobenzo[c][1,2]oxabor ole-6-carboxamido)butanamido)propanoic acid modified residue
  DISULFID 6..11: note = Intrachain disulfide bond
  DISULFID 7: note = Interchain disulfide bond with the cysteine at position 12 of SEQ ID NO: 25403
  DISULFID 20: note = Interchain disulfide bond with the cysteine at position 24 of SEQ ID NO: 25403
GIVEQCCTSICSLYQLENYCGK

SEQ ID NO: 25403 - protein, 34 aa, synthetic construct; identical to SEQ ID NO: 25393
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25402
  DISULFID 24: note = Interchain disulfide bond with the cysteine at position 20 of SEQ ID NO: 25402

SEQ ID NO: 25404 - protein, 21 aa, synthetic construct
  DISULFID 6..11: note = Intrachain disulfide bond
  DISULFID 7: note = Interchain disulfide bond with the cysteine at position 12 of SEQ ID NO: 25405
  DISULFID 20: note = Interchain disulfide bond with the cysteine at position 24 of SEQ ID NO: 25405
GIVEQCCTSICSLYQLENYCG

SEQ ID NO: 25405 - protein, 34 aa, synthetic construct; identical to SEQ ID NO: 25310
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25404
  DISULFID 24: note = Interchain disulfide bond with the cysteine at position 20 of SEQ ID NO: 25404

SEQ ID NO: 25406 - protein, 21 aa, synthetic construct
  DISULFID 6..11: note = Intrachain disulfide bond
  DISULFID 7: note = Interchain disulfide bond with the cysteine at position 11 of SEQ ID NO: 25407
  DISULFID 20: note = Interchain disulfide bond with the cysteine at position 23 of SEQ ID NO: 25407
GIVEQCCTSICSLYQLENYCG

SEQ ID NO: 25407 - protein, 33 aa, synthetic construct; identical to SEQ ID NO: 24061
  SITE 1: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  SITE 25: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  DISULFID 11: note = Interchain disulfide bond with the cysteine at position 7 of SEQ ID NO: 25406
  DISULFID 23: note = Interchain disulfide bond with the cysteine at position 20 of SEQ ID NO: 25406

SEQ ID NO: 25408 - protein, 21 aa, synthetic construct
  DISULFID 6..11: note = Intrachain disulfide bond
  DISULFID 7: note = Interchain disulfide bond with the cysteine at position 25 of SEQ ID NO: 25409
  DISULFID 20: note = Interchain disulfide bond with the cysteine at position 37 of SEQ ID NO: 25409
GIVEQCCTSICSLYQLENYCN

SEQ ID NO: 25409 - protein, 47 aa, synthetic construct; identical to SEQ ID NO: 24064
  SITE 2: note 3-((2S,3S)-3-(1-hydroxy-1,3-dihydrobenzo[c][1,2]oxaborole-6 -carboxamido)-2-(1-hydroxy-4-(trifluoromethyl)-1,3-dihydrob enzo[c][1,2]oxaborole-6-carboxamido)butanamido)propanoic acid modified residue
  SITE 47: note 3-((2S,3S)-3-(1-hydroxy-1,3-dihydrobenzo[c][1,2]oxaborole-6 -carboxamido)-2-(1-hydroxy-4-(trifluoromethyl)-1,3-dihydrob enzo[c][1,2]oxaborole-6-carboxamido)butanamido)propanoic acid modified residue
  DISULFID 25: note = Interchain disulfide bond with the cysteine at position 7 of SEQ ID NO: 25408
  DISULFID 37: note = Interchain disulfide bond with the cysteine at position 20 of SEQ ID NO: 25408

SEQ ID NO: 25410 - protein, 22 aa, synthetic construct
  SITE 22: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 6..11: note = Intrachain disulfide bond
  DISULFID 7: note = Interchain disulfide bond with the cysteine at position 12 of SEQ ID NO: 25411
  DISULFID 20: note = Interchain disulfide bond with the cysteine at position 24 of SEQ ID NO: 25411
GIVEQCCTSICSLYQLENYCGK

SEQ ID NO: 25411 - protein, 34 aa, synthetic construct; identical to SEQ ID NO: 25393
  SITE 1: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 5: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 26: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 12: note = Interchain disulfide bond with the cysteine at position 7 of SEQ ID NO: 25410
  DISULFID 24: note = Interchain disulfide bond with the cysteine at position 20 of SEQ ID NO: 25410

SEQ ID NO: 25412 - protein, 21 aa, synthetic construct
  DISULFID 6..11: note = Intrachain disulfide bond
  DISULFID 7: note = Interchain disulfide bond with the cysteine at position 12 of SEQ ID NO: 25413
  DISULFID 20: note = Interchain disulfide bond with the cysteine at position 24 of SEQ ID NO: 25413
GIVEQCCTSICSLYQLENYCG

SEQ ID NO: 25413 - protein, 34 aa, synthetic construct; identical to SEQ ID NO: 25313
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25412
  DISULFID 24: note = Interchain disulfide bond with the cysteine at position 20 of SEQ ID NO: 25412

SEQ ID NO: 25414 - protein, 21 aa, synthetic construct
  DISULFID 6..11: note = Intrachain disulfide bond
  DISULFID 7: note = Interchain disulfide bond with the cysteine at position 11 of SEQ ID NO: 25415
  DISULFID 20: note = Interchain disulfide bond with the cysteine at position 23 of SEQ ID NO: 25415
GIVEQCCTSICSLYQLENYCG

SEQ ID NO: 25415 - protein, 33 aa, synthetic construct; identical to SEQ ID NO: 24061
  SITE 1: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 25: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 11: note = Interchain disulfide bond with the cysteine at position 7 of SEQ ID NO: 25414
  DISULFID 23: note = Interchain disulfide bond with the cysteine at position 20 of SEQ ID NO: 25414

SEQ ID NO: 25416 - protein, 21 aa, synthetic construct
  DISULFID 6..11: note = Intrachain disulfide bond
  DISULFID 7: note = Interchain disulfide bond with the cysteine at position 13 of SEQ ID NO: 25417
  DISULFID 20: note = Interchain disulfide bond with the cysteine at position 25 of SEQ ID NO: 25417
GIVEQCCTSICSLYQLENYCN

SEQ ID NO: 25417 - protein, 36 aa, synthetic construct; identical to SEQ ID NO: 25237
  SITE 2: note 3-((2S,3S)-2,3-bis(1-hydroxy-1,3-dihydrobenzo[c][1,2]oxabor ole-6-carboxamido)butanamido)propanoic acid modified residue
  SITE 6: note 3-((2S,3S)-2,3-bis(1-hydroxy-1,3-dihydrobenzo[c][1,2]oxabor ole-6-carboxamido)butanamido)propanoic acid modified residue
  SITE 27: note 3-((2S,3S)-2,3-bis(1-hydroxy-1,3-dihydrobenzo[c][1,2]oxabor ole-6-carboxamido)butanamido)propanoic acid modified residue
  DISULFID 13: note = Interchain disulfide bond with the cysteine at position 7 of SEQ ID NO: 25416
  DISULFID 25: note = Interchain disulfide bond with the cysteine at position 20 of SEQ ID NO: 25416

SEQ ID NO: 25418 - protein, 21 aa, synthetic construct
  DISULFID 6..11: note = Intrachain disulfide bond
  DISULFID 7: note = Interchain disulfide bond with the cysteine at position 25 of SEQ ID NO: 25419
  DISULFID 20: note = Interchain disulfide bond with the cysteine at position 37 of SEQ ID NO: 25419
GIVEQCCTSICSLYQLENYCN

SEQ ID NO: 25419 - protein, 47 aa, synthetic construct; identical to SEQ ID NO: 24064
  SITE 2: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 47: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 25: note = Interchain disulfide bond with the cysteine at position 7 of SEQ ID NO: 25418
  DISULFID 37: note = Interchain disulfide bond with the cysteine at position 20 of SEQ ID NO: 25418

SEQ ID NO: 25420 - protein, 21 aa, synthetic construct
  DISULFID 6..11: note = Intrachain disulfide bond
  DISULFID 7: note = Interchain disulfide bond with the cysteine at position 8 of SEQ ID NO: 25421
  DISULFID 20: note = Interchain disulfide bond with the cysteine at position 20 of SEQ ID NO: 25421
GIVEQCCTSICSLYQLENYCG

SEQ ID NO: 25421 - protein, 30 aa, synthetic construct; identical to SEQ ID NO: 24062
  SITE 1: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 22: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 8: note = Interchain disulfide bond with the cysteine at position 7 of SEQ ID NO: 25420
  DISULFID 20: note = Interchain disulfide bond with the cysteine at position 20 of SEQ ID NO: 25420

SEQ ID NO: 25422 - protein, 21 aa, synthetic construct
  DISULFID 6..11: note = Intrachain disulfide bond
  DISULFID 7: note = Interchain disulfide bond with the cysteine at position 25 of SEQ ID NO: 25423
  DISULFID 20: note = Interchain disulfide bond with the cysteine at position 37 of SEQ ID NO: 25423
GIVEQCCTSICSLYQLENYCN

SEQ ID NO: 25423 - protein, 47 aa, synthetic construct; identical to SEQ ID NO: 24064
  SITE 2: note ((2S,4R)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  SITE 47: note ((2S,4R)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  DISULFID 25: note = Interchain disulfide bond with the cysteine at position 7 of SEQ ID NO: 25422
  DISULFID 37: note = Interchain disulfide bond with the cysteine at position 20 of SEQ ID NO: 25422

SEQ ID NO: 25424 - protein, 22 aa, synthetic construct
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  DISULFID 6..11: note = Intrachain disulfide bond
  DISULFID 7: note = Interchain disulfide bond with the cysteine at position 12 of SEQ ID NO: 25425
  DISULFID 20: note = Interchain disulfide bond with the cysteine at position 24 of SEQ ID NO: 25425
GIVEQCCTSICSLYQLENYCGK

SEQ ID NO: 25425 - protein, 34 aa, synthetic construct; identical to SEQ ID NO: 25393
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 5: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 26: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  DISULFID 12: note = Interchain disulfide bond with the cysteine at position 7 of SEQ ID NO: 25424
  DISULFID 24: note = Interchain disulfide bond with the cysteine at position 20 of SEQ ID NO: 25424

SEQ ID NO: 25426 - protein, 21 aa, synthetic construct
  DISULFID 6..11: note = Intrachain disulfide bond
  DISULFID 7: note = Interchain disulfide bond with the cysteine at position 12 of SEQ ID NO: 25427
  DISULFID 20: note = Interchain disulfide bond with the cysteine at position 24 of SEQ ID NO: 25427
GIVEQCCTSICSLYQLENYCG

SEQ ID NO: 25427 - protein, 34 aa, synthetic construct; identical to SEQ ID NO: 25311
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25426
  DISULFID 24: note = Interchain disulfide bond with the cysteine at position 20 of SEQ ID NO: 25426

SEQ ID NO: 25428 - protein, 21 aa, synthetic construct
  DISULFID 6..11: note = Intrachain disulfide bond
  DISULFID 7: note = Interchain disulfide bond with the cysteine at position 12 of SEQ ID NO: 25429
  DISULFID 20: note = Interchain disulfide bond with the cysteine at position 24 of SEQ ID NO: 25429
GIVEQCCTSICSLYQLENYCG

SEQ ID NO: 25429 - protein, 34 aa, synthetic construct; identical to SEQ ID NO: 25312
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25428
  DISULFID 24: note = Interchain disulfide bond with the cysteine at position 20 of SEQ ID NO: 25428

SEQ ID NO: 25430 - protein, 21 aa, synthetic construct
  DISULFID 6..11: note = Intrachain disulfide bond
  DISULFID 7: note = Interchain disulfide bond with the cysteine at position 12 of SEQ ID NO: 25431
  DISULFID 20: note = Interchain disulfide bond with the cysteine at position 24 of SEQ ID NO: 25431
GIVEQCCTSICSLYQLENYCG

SEQ ID NO: 25431 - protein, 34 aa, synthetic construct; identical to SEQ ID NO: 25313
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-(trifluoro methyl)phenyl)propanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-(trifluoro methyl)phenyl)propanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-(trifluoro methyl)phenyl)propanoic acid modified residue
  DISULFID 12: note = Interchain disulfide bond with the cysteine at position 7 of SEQ ID NO: 25430
  DISULFID 24: note = Interchain disulfide bond with the cysteine at position 20 of SEQ ID NO: 25430

SEQ ID NO: 25432 - protein, 21 aa, synthetic construct
  DISULFID 6..11: note = Intrachain disulfide bond
  DISULFID 7: note = Interchain disulfide bond with the cysteine at position 25 of SEQ ID NO: 25433
  DISULFID 20: note = Interchain disulfide bond with the cysteine at position 37 of SEQ ID NO: 25433
GIVEQCCTSICSLYQLENYCN

SEQ ID NO: 25433 - protein, 47 aa, synthetic construct; identical to SEQ ID NO: 24064
  SITE 2: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 47: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 25: note = Interchain disulfide bond with the cysteine at position 7 of SEQ ID NO: 25432
  DISULFID 37: note = Interchain disulfide bond with the cysteine at position 20 of SEQ ID NO: 25432

SEQ ID NO: 25434 - protein, 21 aa, synthetic construct
  DISULFID 6..11: note = Intrachain disulfide bond
  DISULFID 7: note = Interchain disulfide bond with the cysteine at position 13 of SEQ ID NO: 25435
  DISULFID 20: note = Interchain disulfide bond with the cysteine at position 25 of SEQ ID NO: 25435
GIVEQCCTSICSLYQLENYCN

SEQ ID NO: 25435 - protein, 35 aa, synthetic construct; identical to SEQ ID NO: 25228
  SITE 2: note 3-((2S,3S)-2,3-bis(1-hydroxy-1,3-dihydrobenzo[c][1,2]oxabor ole-6-carboxamido)butanamido)propanoic acid modified residue
  SITE 6: note 3-((2S,3S)-2,3-bis(1-hydroxy-1,3-dihydrobenzo[c][1,2]oxabor ole-6-carboxamido)butanamido)propanoic acid modified residue
  SITE 27: note 3-((2S,3S)-2,3-bis(1-hydroxy-1,3-dihydrobenzo[c][1,2]oxabor ole-6-carboxamido)butanamido)propanoic acid modified residue
  DISULFID 13: note = Interchain disulfide bond with the cysteine at position 7 of SEQ ID NO: 25434
  DISULFID 25: note = Interchain disulfide bond with the cysteine at position 20 of SEQ ID NO: 25434

SEQ ID NO: 25436 - protein, 21 aa, synthetic construct
  DISULFID 6..11: note = Intrachain disulfide bond
  DISULFID 7: note = Interchain disulfide bond with the cysteine at position 25 of SEQ ID NO: 25437
  DISULFID 20: note = Interchain disulfide bond with the cysteine at position 37 of SEQ ID NO: 25437
GIVEQCCTSICSLYQLENYCN

SEQ ID NO: 25437 - protein, 47 aa, synthetic construct; identical to SEQ ID NO: 24064
  SITE 2: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  SITE 47: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  DISULFID 25: note = Interchain disulfide bond with the cysteine at position 7 of SEQ ID NO: 25436
  DISULFID 37: note = Interchain disulfide bond with the cysteine at position 20 of SEQ ID NO: 25436

SEQ ID NO: 25438 - protein, 22 aa, synthetic construct
  SITE 22: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  DISULFID 6..11: note = Intrachain disulfide bond
  DISULFID 7: note = Interchain disulfide bond with the cysteine at position 12 of SEQ ID NO: 25439
  DISULFID 20: note = Interchain disulfide bond with the cysteine at position 24 of SEQ ID NO: 25439
GIVEQCCTSICSLYQLENYCGK

SEQ ID NO: 25439 - protein, 34 aa, synthetic construct; identical to SEQ ID NO: 25393
  SITE 1: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  SITE 5: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  SITE 26: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  DISULFID 12: note = Interchain disulfide bond with the cysteine at position 7 of SEQ ID NO: 25438
  DISULFID 24: note = Interchain disulfide bond with the cysteine at position 20 of SEQ ID NO: 25438

SEQ ID NO: 25440 - protein, 21 aa, synthetic construct
  DISULFID 6..11: note = Intrachain disulfide bond
  DISULFID 7: note = Interchain disulfide bond with the cysteine at position 8 of SEQ ID NO: 25441
  DISULFID 20: note = Interchain disulfide bond with the cysteine at position 20 of SEQ ID NO: 25441
GIVEQCCTSICSLYQLENYCN

SEQ ID NO: 25441 - protein, 31 aa, synthetic construct; identical to SEQ ID NO: 24060
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 22: note 3-((2S,3S)-2,3-bis(1-hydroxy-1,3-dihydrobenzo[c][1,2]oxabor ole-6-carboxamido)butanamido)propanoic acid modified residue
  SITE 30: note 3-((2S,3S)-2,3-bis(1-hydroxy-1,3-dihydrobenzo[c][1,2]oxabor ole-6-carboxamido)butanamido)propanoic acid modified residue
  DISULFID 8: note = Interchain disulfide bond with the cysteine at position 7 of SEQ ID NO: 25440
  DISULFID 20: note = Interchain disulfide bond with the cysteine at position 20 of SEQ ID NO: 25440

SEQ ID NO: 25442 - protein, 21 aa, synthetic construct
  DISULFID 6..11: note = Intrachain disulfide bond
  DISULFID 7: note = Interchain disulfide bond with the cysteine at position 8 of SEQ ID NO: 25443
  DISULFID 20: note = Interchain disulfide bond with the cysteine at position 20 of SEQ ID NO: 25443
GIVEQCCTSICSLYQLENYCN

SEQ ID NO: 25443 - protein, 31 aa, synthetic construct; identical to SEQ ID NO: 24060
  SITE 1: note (S)-7-amino-3-((2S,3S)-2,3-bis(1-hydroxy-1,3-dihydrobenzo[c ][1,2]oxaborole-6-carboxamido)butanamido)heptanoic acid modified residue
  SITE 22: note (S)-7-amino-3-((2S,3S)-2,3-bis(1-hydroxy-1,3-dihydrobenzo[c ][1,2]oxaborole-6-carboxamido)butanamido)heptanoic acid modified residue
  SITE 30: note (S)-7-amino-3-((2S,3S)-2,3-bis(1-hydroxy-1,3-dihydrobenzo[c ][1,2]oxaborole-6-carboxamido)butanamido)heptanoic acid modified residue
  DISULFID 8: note = Interchain disulfide bond with the cysteine at position 7 of SEQ ID NO: 25442
  DISULFID 20: note = Interchain disulfide bond with the cysteine at position 20 of SEQ ID NO: 25442

SEQ ID NO: 25444 - protein, 21 aa, synthetic construct
  DISULFID 6..11: note = Intrachain disulfide bond
  DISULFID 7: note = Interchain disulfide bond with the cysteine at position 13 of SEQ ID NO: 25445
  DISULFID 20: note = Interchain disulfide bond with the cysteine at position 25 of SEQ ID NO: 25445
GIVEQCCTSICSLYQLENYCN

SEQ ID NO: 25445 - protein, 36 aa, synthetic construct; identical to SEQ ID NO: 25237
  SITE 2: note 4-((2S,3S)-2,3-bis(1-hydroxy-1,3-dihydrobenzo[c][1,2]oxabor ole-6-carboxamido)butanamido)butanoic acid modified residue
  SITE 6: note 4-((2S,3S)-2,3-bis(1-hydroxy-1,3-dihydrobenzo[c][1,2]oxabor ole-6-carboxamido)butanamido)butanoic acid modified residue
  SITE 27: note 4-((2S,3S)-2,3-bis(1-hydroxy-1,3-dihydrobenzo[c][1,2]oxabor ole-6-carboxamido)butanamido)butanoic acid modified residue
  DISULFID 13: note = Interchain disulfide bond with the cysteine at position 7 of SEQ ID NO: 25444
  DISULFID 25: note = Interchain disulfide bond with the cysteine at position 20 of SEQ ID NO: 25444

SEQ ID NO: 25446 - protein, 21 aa, synthetic construct
  DISULFID 6..11: note = Intrachain disulfide bond
  DISULFID 7: note = Interchain disulfide bond with the cysteine at position 8 of SEQ ID NO: 25447
  DISULFID 20: note = Interchain disulfide bond with the cysteine at position 20 of SEQ ID NO: 25447
GIVEQCCTSICSLYQLENYCN

SEQ ID NO: 25447 - protein, 31 aa, synthetic construct; identical to SEQ ID NO: 24060
  SITE 1: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  SITE 22: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  SITE 30: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  DISULFID 8: note = Interchain disulfide bond with the cysteine at position 7 of SEQ ID NO: 25446
  DISULFID 20: note = Interchain disulfide bond with the cysteine at position 20 of SEQ ID NO: 25446

SEQ ID NO: 25448 - protein, 21 aa, synthetic construct
  DISULFID 6..11: note = Intrachain disulfide bond
  DISULFID 7: note = Interchain disulfide bond with the cysteine at position 8 of SEQ ID NO: 25449
  DISULFID 20: note = Interchain disulfide bond with the cysteine at position 20 of SEQ ID NO: 25449
GIVEQCCTSICSLYQLENYCN

SEQ ID NO: 25449 - protein, 31 aa, synthetic construct; identical to SEQ ID NO: 24060
  SITE 1: note (S)-3-(2,3-bis(1-hydroxy-1,3-dihydrobenzo[c][1,2]oxaborole- 6-carboxamido)-2-methylpropanamido)propanoic acid modified residue
  SITE 22: note (S)-3-(2,3-bis(1-hydroxy-1,3-dihydrobenzo[c][1,2]oxaborole- 6-carboxamido)-2-methylpropanamido)propanoic acid modified residue
  SITE 30: note (S)-3-(2,3-bis(1-hydroxy-1,3-dihydrobenzo[c][1,2]oxaborole- 6-carboxamido)-2-methylpropanamido)propanoic acid modified residue
  DISULFID 8: note = Interchain disulfide bond with the cysteine at position 7 of SEQ ID NO: 25448
  DISULFID 20: note = Interchain disulfide bond with the cysteine at position 20 of SEQ ID NO: 25448

SEQ ID NO: 25450 - protein, 21 aa, synthetic construct
  DISULFID 6..11: note = Intrachain disulfide bond
  DISULFID 7: note = Interchain disulfide bond with the cysteine at position 8 of SEQ ID NO: 25451
  DISULFID 20: note = Interchain disulfide bond with the cysteine at position 20 of SEQ ID NO: 25451
GIVEQCCTSICSLYQLENYCN

SEQ ID NO: 25451 - protein, 31 aa, synthetic construct; identical to SEQ ID NO: 24060
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 30: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 8: note = Interchain disulfide bond with the cysteine at position 7 of SEQ ID NO: 25450
  DISULFID 20: note = Interchain disulfide bond with the cysteine at position 20 of SEQ ID NO: 25450

SEQ ID NO: 25452 - protein, 21 aa, synthetic construct
  DISULFID 6..11: note = Intrachain disulfide bond
  DISULFID 7: note = Interchain disulfide bond with the cysteine at position 8 of SEQ ID NO: 25453
  DISULFID 20: note = Interchain disulfide bond with the cysteine at position 20 of SEQ ID NO: 25453
GIVEQCCTSICSLYQLENYCN

SEQ ID NO: 25453 - protein, 31 aa, synthetic construct; identical to SEQ ID NO: 24060
  SITE 1: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 22: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 30: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  DISULFID 8: note = Interchain disulfide bond with the cysteine at position 7 of SEQ ID NO: 25452
  DISULFID 20: note = Interchain disulfide bond with the cysteine at position 20 of SEQ ID NO: 25452

SEQ ID NO: 25454 - protein, 21 aa, synthetic construct
  DISULFID 6..11: note = Intrachain disulfide bond
  DISULFID 7: note = Interchain disulfide bond with the cysteine at position 8 of SEQ ID NO: 25455
  DISULFID 20: note = Interchain disulfide bond with the cysteine at position 20 of SEQ ID NO: 25455
GIVEQCCTSICSLYQLENYCN

SEQ ID NO: 25455 - protein, 31 aa, synthetic construct; identical to SEQ ID NO: 24060
  SITE 1: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 22: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 30: note 3-((2S,3S)-2,3-bis(4-fluoro-1-hydroxy-1,3-dihydrobenzo[c][1 ,2]oxaborole-6-carboxamido)butanamido)propanoic acid modified residue
  DISULFID 8: note = Interchain disulfide bond with the cysteine at position 7 of SEQ ID NO: 25454
  DISULFID 20: note = Interchain disulfide bond with the cysteine at position 20 of SEQ ID NO: 25454

SEQ ID NO: 25456 - protein, 21 aa, synthetic construct
  DISULFID 6..11: note = Intrachain disulfide bond
  DISULFID 7: note = Interchain disulfide bond with the cysteine at position 13 of SEQ ID NO: 25457
  DISULFID 20: note = Interchain disulfide bond with the cysteine at position 25 of SEQ ID NO: 25457
GIVEQCCTSICSLYQLENYCN

SEQ ID NO: 25457 - protein, 36 aa, synthetic construct; identical to SEQ ID NO: 25237
  SITE 2: note 3-((2S,3R)-2,3-bis(1-hydroxy-1,3-dihydrobenzo[c][1,2]oxabor ole-6-carboxamido)-4-(hydroxyamino)-4-oxobutanamido)propano ic acid modified residue
  SITE 6: note 3-((2S,3R)-2,3-bis(1-hydroxy-1,3-dihydrobenzo[c][1,2]oxabor ole-6-carboxamido)-4-(hydroxyamino)-4-oxobutanamido)propano ic acid modified residue
  SITE 27: note 3-((2S,3R)-2,3-bis(1-hydroxy-1,3-dihydrobenzo[c][1,2]oxabor ole-6-carboxamido)-4-(hydroxyamino)-4-oxobutanamido)propano ic acid modified residue
  DISULFID 13: note = Interchain disulfide bond with the cysteine at position 7 of SEQ ID NO: 25456
  DISULFID 25: note = Interchain disulfide bond with the cysteine at position 20 of SEQ ID NO: 25456

SEQ ID NO: 25458 - protein, 21 aa, synthetic construct
  DISULFID 6..11: note = Intrachain disulfide bond
  DISULFID 7: note = Interchain disulfide bond with the cysteine at position 8 of SEQ ID NO: 25459
  DISULFID 20: note = Interchain disulfide bond with the cysteine at position 20 of SEQ ID NO: 25459
GIVEQCCTSICSLYQLENYCN

SEQ ID NO: 25459 - protein, 31 aa, synthetic construct; identical to SEQ ID NO: 24060
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 30: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  DISULFID 8: note = Interchain disulfide bond with the cysteine at position 7 of SEQ ID NO: 25458
  DISULFID 20: note = Interchain disulfide bond with the cysteine at position 20 of SEQ ID NO: 25458

SEQ ID NO: 25460 - protein, 21 aa, synthetic construct
  DISULFID 6..11: note = Intrachain disulfide bond
  DISULFID 7: note = Interchain disulfide bond with the cysteine at position 8 of SEQ ID NO: 25461
  DISULFID 20: note = Interchain disulfide bond with the cysteine at position 20 of SEQ ID NO: 25461
GIVEQCCTSICSLYQLENYCN

SEQ ID NO: 25461 - protein, 31 aa, synthetic construct; identical to SEQ ID NO: 24060
  SITE 1: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  SITE 22: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  SITE 30: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  DISULFID 8: note = Interchain disulfide bond with the cysteine at position 7 of SEQ ID NO: 25460
  DISULFID 20: note = Interchain disulfide bond with the cysteine at position 20 of SEQ ID NO: 25460

SEQ ID NO: 25462 - protein, 21 aa, synthetic construct
  DISULFID 6..11: note = Intrachain disulfide bond
  DISULFID 7: note = Interchain disulfide bond with the cysteine at position 8 of SEQ ID NO: 25463
  DISULFID 20: note = Interchain disulfide bond with the cysteine at position 20 of SEQ ID NO: 25463
GIVEQCCTSICSLYQLENYCN

SEQ ID NO: 25463 - protein, 31 aa, synthetic construct; identical to SEQ ID NO: 24060
  SITE 1: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 22: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 30: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 8: note = Interchain disulfide bond with the cysteine at position 7 of SEQ ID NO: 25462
  DISULFID 20: note = Interchain disulfide bond with the cysteine at position 20 of SEQ ID NO: 25462

SEQ ID NO: 25464 - protein, 21 aa, synthetic construct
  DISULFID 6..11: note = Intrachain disulfide bond
  DISULFID 7: note = Interchain disulfide bond with the cysteine at position 8 of SEQ ID NO: 25465
  DISULFID 20: note = Interchain disulfide bond with the cysteine at position 20 of SEQ ID NO: 25465
GIVEQCCTSICSLYQLENYCN

SEQ ID NO: 25465 - protein, 31 aa, synthetic construct; identical to SEQ ID NO: 24060
  SITE 1: note ((2S,3S)-2,3-bis(1-hydroxy-1,3-dihydrobenzo[c][1,2]oxaborol e-6-carboxamido)butanoyl)-L-glutamic acid modified residue
  SITE 22: note ((2S,3S)-2,3-bis(1-hydroxy-1,3-dihydrobenzo[c][1,2]oxaborol e-6-carboxamido)butanoyl)-L-glutamic acid modified residue
  SITE 30: note ((2S,3S)-2,3-bis(1-hydroxy-1,3-dihydrobenzo[c][1,2]oxaborol e-6-carboxamido)butanoyl)-L-glutamic acid modified residue
  DISULFID 8: note = Interchain disulfide bond with the cysteine at position 7 of SEQ ID NO: 25464
  DISULFID 20: note = Interchain disulfide bond with the cysteine at position 20 of SEQ ID NO: 25464

SEQ ID NO: 25466 - protein, 21 aa, synthetic construct
  DISULFID 6..11: note = Intrachain disulfide bond
  DISULFID 7: note = Interchain disulfide bond with the cysteine at position 13 of SEQ ID NO: 25467
  DISULFID 20: note = Interchain disulfide bond with the cysteine at position 25 of SEQ ID NO: 25467
GIVEQCCTSICSLYQLENYCN

SEQ ID NO: 25467 - protein, 36 aa, synthetic construct; identical to SEQ ID NO: 25237
  SITE 2: note 3-((2S,3S)-2,3-bis(1-hydroxy-1,3-dihydrobenzo[c][1,2]oxabor ole-6-carboxamido)-4-(methylamino)-4-oxobutanamido)propanoi c acid modified residue
  SITE 6: note 3-((2S,3S)-2,3-bis(1-hydroxy-1,3-dihydrobenzo[c][1,2]oxabor ole-6-carboxamido)-4-(methylamino)-4-oxobutanamido)propanoi c acid modified residue
  SITE 27: note 3-((2S,3S)-2,3-bis(1-hydroxy-1,3-dihydrobenzo[c][1,2]oxabor ole-6-carboxamido)-4-(methylamino)-4-oxobutanamido)propanoi c acid modified residue
  DISULFID 13: note = Interchain disulfide bond with the cysteine at position 7 of SEQ ID NO: 25466
  DISULFID 25: note = Interchain disulfide bond with the cysteine at position 20 of SEQ ID NO: 25466

SEQ ID NO: 25468 - protein, 21 aa, synthetic construct
  DISULFID 6..11: note = Intrachain disulfide bond
  DISULFID 7: note = Interchain disulfide bond with the cysteine at position 8 of SEQ ID NO: 25469
  DISULFID 20: note = Interchain disulfide bond with the cysteine at position 20 of SEQ ID NO: 25469
GIVEQCCTSICSLYQLENYCN

SEQ ID NO: 25469 - protein, 31 aa, synthetic construct; identical to SEQ ID NO: 24060
  SITE 1: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 22: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 30: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  DISULFID 8: note = Interchain disulfide bond with the cysteine at position 7 of SEQ ID NO: 25468
  DISULFID 20: note = Interchain disulfide bond with the cysteine at position 20 of SEQ ID NO: 25468

SEQ ID NO: 25470 - protein, 21 aa, synthetic construct
  DISULFID 6..11: note = Intrachain disulfide bond
  DISULFID 7: note = Interchain disulfide bond with the cysteine at position 8 of SEQ ID NO: 25471
  DISULFID 20: note = Interchain disulfide bond with the cysteine at position 20 of SEQ ID NO: 25471
GIVEQCCTSICSLYQLENYCN

SEQ ID NO: 25471 - protein, 31 aa, synthetic construct; identical to SEQ ID NO: 24060
  SITE 1: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 22: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 30: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  DISULFID 8: note = Interchain disulfide bond with the cysteine at position 7 of SEQ ID NO: 25470
  DISULFID 20: note = Interchain disulfide bond with the cysteine at position 20 of SEQ ID NO: 25470

SEQ ID NO: 25472 - protein, 21 aa, synthetic construct
  DISULFID 6..11: note = Intrachain disulfide bond
  DISULFID 7: note = Interchain disulfide bond with the cysteine at position 8 of SEQ ID NO: 25473
  DISULFID 20: note = Interchain disulfide bond with the cysteine at position 20 of SEQ ID NO: 25473
GIVEQCCTSICSLYQLENYCN

SEQ ID NO: 25473 - protein, 31 aa, synthetic construct; identical to SEQ ID NO: 24060
  SITE 1: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 22: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 30: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  DISULFID 8: note = Interchain disulfide bond with the cysteine at position 7 of SEQ ID NO: 25472
  DISULFID 20: note = Interchain disulfide bond with the cysteine at position 20 of SEQ ID NO: 25472

SEQ ID NO: 25474 - protein, 21 aa, synthetic construct
  DISULFID 6..11: note = Intrachain disulfide bond
  DISULFID 7: note = Interchain disulfide bond with the cysteine at position 8 of SEQ ID NO: 25475
  DISULFID 20: note = Interchain disulfide bond with the cysteine at position 20 of SEQ ID NO: 25475
GIVEQCCTSICSLYQLENYCN

SEQ ID NO: 25475 - protein, 31 aa, synthetic construct; identical to SEQ ID NO: 24060
  SITE 1: note (S)-3-((2S,3S)-2,3-bis(1-hydroxy-1,3-dihydrobenzo[c][1,2]ox aborole-6-carboxamido)butanamido)-4-hydroxybutanoic acid modified residue
  SITE 22: note (S)-3-((2S,3S)-2,3-bis(1-hydroxy-1,3-dihydrobenzo[c][1,2]ox aborole-6-carboxamido)butanamido)-4-hydroxybutanoic acid modified residue
  SITE 30: note (S)-3-((2S,3S)-2,3-bis(1-hydroxy-1,3-dihydrobenzo[c][1,2]ox aborole-6-carboxamido)butanamido)-4-hydroxybutanoic acid modified residue
  DISULFID 8: note = Interchain disulfide bond with the cysteine at position 7 of SEQ ID NO: 25474
  DISULFID 20: note = Interchain disulfide bond with the cysteine at position 20 of SEQ ID NO: 25474

SEQ ID NO: 25476 - protein, 21 aa, synthetic construct
  DISULFID 6..11: note = Intrachain disulfide bond
  DISULFID 7: note = Interchain disulfide bond with the cysteine at position 13 of SEQ ID NO: 25477
  DISULFID 20: note = Interchain disulfide bond with the cysteine at position 25 of SEQ ID NO: 25477
GIVEQCCTSICSLYQLENYCN

SEQ ID NO: 25477 - protein, 35 aa, synthetic construct; identical to SEQ ID NO: 25228
  SITE 2: note 3-((2S,3S)-3-(1-hydroxy-1,3-dihydrobenzo[c][1,2]oxaborole-6 -carboxamido)-2-(1-hydroxy-4-(trifluoromethyl)-1,3-dihydrob enzo[c][1,2]oxaborole-6-carboxamido)butanamido)propanoic acid modified residue
  SITE 6: note 3-((2S,3S)-3-(1-hydroxy-1,3-dihydrobenzo[c][1,2]oxaborole-6 -carboxamido)-2-(1-hydroxy-4-(trifluoromethyl)-1,3-dihydrob enzo[c][1,2]oxaborole-6-carboxamido)butanamido)propanoic acid modified residue
  SITE 27: note 3-((2S,3S)-3-(1-hydroxy-1,3-dihydrobenzo[c][1,2]oxaborole-6 -carboxamido)-2-(1-hydroxy-4-(trifluoromethyl)-1,3-dihydrob enzo[c][1,2]oxaborole-6-carboxamido)butanamido)propanoic acid modified residue
  DISULFID 13: note = Interchain disulfide bond with the cysteine at position 7 of SEQ ID NO: 25476
  DISULFID 25: note = Interchain disulfide bond with the cysteine at position 20 of SEQ ID NO: 25476

SEQ ID NO: 25478 - protein, 21 aa, synthetic construct
  DISULFID 6..11: note = Intrachain disulfide bond
  DISULFID 7: note = Interchain disulfide bond with the cysteine at position 13 of SEQ ID NO: 25479
  DISULFID 20: note = Interchain disulfide bond with the cysteine at position 25 of SEQ ID NO: 25479
GIVEQCCTSICSLYQLENYCN

SEQ ID NO: 25479 - protein, 35 aa, synthetic construct; identical to SEQ ID NO: 25228
  SITE 2: note 3-((2S,4S)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 6: note 3-((2S,4S)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 27: note 3-((2S,4S)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  DISULFID 13: note = Interchain disulfide bond with the cysteine at position 7 of SEQ ID NO: 25478
  DISULFID 25: note = Interchain disulfide bond with the cysteine at position 20 of SEQ ID NO: 25478

SEQ ID NO: 25480 - protein, 21 aa, synthetic construct
  DISULFID 6..11: note = Intrachain disulfide bond
  DISULFID 7: note = Interchain disulfide bond with the cysteine at position 13 of SEQ ID NO: 25481
  DISULFID 20: note = Interchain disulfide bond with the cysteine at position 25 of SEQ ID NO: 25481
GIVEQCCTSICSLYQLENYCN

SEQ ID NO: 25481 - protein, 35 aa, synthetic construct; identical to SEQ ID NO: 25228
  SITE 2: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 6: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 27: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  DISULFID 13: note = Interchain disulfide bond with the cysteine at position 7 of SEQ ID NO: 25480
  DISULFID 25: note = Interchain disulfide bond with the cysteine at position 20 of SEQ ID NO: 25480

SEQ ID NO: 25482 - protein, 21 aa, synthetic construct
  DISULFID 6..11: note = Intrachain disulfide bond
  DISULFID 7: note = Interchain disulfide bond with the cysteine at position 13 of SEQ ID NO: 25483
  DISULFID 20: note = Interchain disulfide bond with the cysteine at position 25 of SEQ ID NO: 25483
GIVEQCCTSICSLYQLENYCN

SEQ ID NO: 25483 - protein, 35 aa, synthetic construct; identical to SEQ ID NO: 25228
  SITE 2: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 6: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 27: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  DISULFID 13: note = Interchain disulfide bond with the cysteine at position 7 of SEQ ID NO: 25482
  DISULFID 25: note = Interchain disulfide bond with the cysteine at position 20 of SEQ ID NO: 25482

SEQ ID NO: 25484 - protein, 21 aa, synthetic construct
  DISULFID 6..11: note = Intrachain disulfide bond
  DISULFID 7: note = Interchain disulfide bond with the cysteine at position 13 of SEQ ID NO: 25485
  DISULFID 20: note = Interchain disulfide bond with the cysteine at position 25 of SEQ ID NO: 25485
GIVEQCCTSICSLYQLENYCN

SEQ ID NO: 25485 - protein, 35 aa, synthetic construct; identical to SEQ ID NO: 25228
  SITE 2: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 6: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 27: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 13: note = Interchain disulfide bond with the cysteine at position 7 of SEQ ID NO: 25484
  DISULFID 25: note = Interchain disulfide bond with the cysteine at position 20 of SEQ ID NO: 25484

SEQ ID NO: 25486 - protein, 21 aa, synthetic construct
  DISULFID 6..11: note = Intrachain disulfide bond
  DISULFID 7: note = Interchain disulfide bond with the cysteine at position 13 of SEQ ID NO: 25487
  DISULFID 20: note = Interchain disulfide bond with the cysteine at position 25 of SEQ ID NO: 25487
GIVEQCCTSICSLYQLENYCN

SEQ ID NO: 25487 - protein, 35 aa, synthetic construct; identical to SEQ ID NO: 25228
  SITE 2: note (R)-4-amino-3-((2S,3S)-2,3-bis(1-hydroxy-1,3-dihydrobenzo[c ][1,2]oxaborole-6-carboxamido)butanamido)butanoic acid modified residue
  SITE 6: note (R)-4-amino-3-((2S,3S)-2,3-bis(1-hydroxy-1,3-dihydrobenzo[c ][1,2]oxaborole-6-carboxamido)butanamido)butanoic acid modified residue
  SITE 27: note (R)-4-amino-3-((2S,3S)-2,3-bis(1-hydroxy-1,3-dihydrobenzo[c ][1,2]oxaborole-6-carboxamido)butanamido)butanoic acid modified residue
  DISULFID 13: note = Interchain disulfide bond with the cysteine at position 7 of SEQ ID NO: 25486
  DISULFID 25: note = Interchain disulfide bond with the cysteine at position 20 of SEQ ID NO: 25486

SEQ ID NO: 25488 - protein, 21 aa, synthetic construct
  DISULFID 6..11: note = Intrachain disulfide bond
  DISULFID 7: note = Interchain disulfide bond with the cysteine at position 13 of SEQ ID NO: 25489
  DISULFID 20: note = Interchain disulfide bond with the cysteine at position 25 of SEQ ID NO: 25489
GIVEQCCTSICSLYQLENYCN

SEQ ID NO: 25489 - protein, 35 aa, synthetic construct; identical to SEQ ID NO: 25228
  SITE 2: note (S)-6-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-6-oxohe xanoic acid modified residue
  SITE 6: note (S)-6-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-6-oxohe xanoic acid modified residue
  SITE 27: note (S)-6-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-6-oxohe xanoic acid modified residue
  DISULFID 13: note = Interchain disulfide bond with the cysteine at position 7 of SEQ ID NO: 25488
  DISULFID 25: note = Interchain disulfide bond with the cysteine at position 20 of SEQ ID NO: 25488

SEQ ID NO: 25490 - protein, 21 aa, synthetic construct
  DISULFID 6..11: note = Intrachain disulfide bond
  DISULFID 7: note = Interchain disulfide bond with the cysteine at position 13 of SEQ ID NO: 25491
  DISULFID 20: note = Interchain disulfide bond with the cysteine at position 25 of SEQ ID NO: 25491
GIVEQCCTSICSLYQLENYCN

SEQ ID NO: 25491 - protein, 36 aa, synthetic construct; identical to SEQ ID NO: 25396
  SITE 2: note 3-((2S,3S)-2,3-bis(1-hydroxy-1,3-dihydrobenzo[c][1,2]oxabor ole-6-carboxamido)butanamido)propanoic acid modified residue
  SITE 6: note 3-((2S,3S)-2,3-bis(1-hydroxy-1,3-dihydrobenzo[c][1,2]oxabor ole-6-carboxamido)butanamido)propanoic acid modified residue
  SITE 27: note 3-((2S,3S)-2,3-bis(1-hydroxy-1,3-dihydrobenzo[c][1,2]oxabor ole-6-carboxamido)butanamido)propanoic acid modified residue
  DISULFID 13: note = Interchain disulfide bond with the cysteine at position 7 of SEQ ID NO: 25490
  DISULFID 25: note = Interchain disulfide bond with the cysteine at position 20 of SEQ ID NO: 25490

SEQ ID NO: 25492 - protein, 21 aa, synthetic construct
  DISULFID 6..11: note = Intrachain disulfide bond
  DISULFID 7: note = Interchain disulfide bond with the cysteine at position 13 of SEQ ID NO: 25493
  DISULFID 20: note = Interchain disulfide bond with the cysteine at position 25 of SEQ ID NO: 25493
GIVEQCCTSICSLYQLENYCN

SEQ ID NO: 25493 - protein, 35 aa, synthetic construct; identical to SEQ ID NO: 25228
  SITE 2: note S)-3-((2S,3S)-2,3-bis(1-hydroxy-1,3-dihydrobenzo[c][1,2]oxa borole-6-carboxamido)butanamido)hexanedioic acid modified residue
  SITE 6: note S)-3-((2S,3S)-2,3-bis(1-hydroxy-1,3-dihydrobenzo[c][1,2]oxa borole-6-carboxamido)butanamido)hexanedioic acid modified residue
  SITE 27: note S)-3-((2S,3S)-2,3-bis(1-hydroxy-1,3-dihydrobenzo[c][1,2]oxa borole-6-carboxamido)butanamido)hexanedioic acid modified residue
  DISULFID 13: note = Interchain disulfide bond with the cysteine at position 7 of SEQ ID NO: 25492
  DISULFID 25: note = Interchain disulfide bond with the cysteine at position 20 of SEQ ID NO: 25492

SEQ ID NO: 25494 - protein, 21 aa, synthetic construct
  DISULFID 6..11: note = Intrachain disulfide bond
  DISULFID 7: note = Interchain disulfide bond with the cysteine at position 13 of SEQ ID NO: 25495
  DISULFID 20: note = Interchain disulfide bond with the cysteine at position 25 of SEQ ID NO: 25495
GIVEQCCTSICSLYQLENYCN

SEQ ID NO: 25495 - protein, 35 aa, synthetic construct; identical to SEQ ID NO: 25228
  SITE 2: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 6: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 27: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 13: note = Interchain disulfide bond with the cysteine at position 7 of SEQ ID NO: 25494
  DISULFID 25: note = Interchain disulfide bond with the cysteine at position 20 of SEQ ID NO: 25494

SEQ ID NO: 25496 - protein, 21 aa, synthetic construct
  DISULFID 6..11: note = Intrachain disulfide bond
  DISULFID 7: note = Interchain disulfide bond with the cysteine at position 13 of SEQ ID NO: 25497
  DISULFID 20: note = Interchain disulfide bond with the cysteine at position 25 of SEQ ID NO: 25497
GIVEQCCTSICSLYQLENYCN

SEQ ID NO: 25497 - protein, 35 aa, synthetic construct; identical to SEQ ID NO: 25228
  SITE 2: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 6: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 27: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  DISULFID 13: note = Interchain disulfide bond with the cysteine at position 7 of SEQ ID NO: 25496
  DISULFID 25: note = Interchain disulfide bond with the cysteine at position 20 of SEQ ID NO: 25496

SEQ ID NO: 25498 - protein, 21 aa, synthetic construct
  DISULFID 6..11: note = Intrachain disulfide bond
  DISULFID 7: note = Interchain disulfide bond with the cysteine at position 13 of SEQ ID NO: 25499
  DISULFID 20: note = Interchain disulfide bond with the cysteine at position 25 of SEQ ID NO: 25499
GIVEQCCTSICSLYQLENYCN

SEQ ID NO: 25499 - protein, 35 aa, synthetic construct; identical to SEQ ID NO: 25228
  SITE 2: note (S)-3-((2S,3S)-2,3-bis(1-hydroxy-1,3-dihydrobenzo[c][1,2]ox aborole-6-carboxamido)butanamido)-4-(4-hydroxyphenyl)butano ic acid modified residue
  SITE 6: note (S)-3-((2S,3S)-2,3-bis(1-hydroxy-1,3-dihydrobenzo[c][1,2]ox aborole-6-carboxamido)butanamido)-4-(4-hydroxyphenyl)butano ic acid modified residue
  SITE 27: note (S)-3-((2S,3S)-2,3-bis(1-hydroxy-1,3-dihydrobenzo[c][1,2]ox aborole-6-carboxamido)butanamido)-4-(4-hydroxyphenyl)butano ic acid modified residue
  DISULFID 13: note = Interchain disulfide bond with the cysteine at position 7 of SEQ ID NO: 25498
  DISULFID 25: note = Interchain disulfide bond with the cysteine at position 20 of SEQ ID NO: 25498

SEQ ID NO: 25500 - protein, 21 aa, synthetic construct
  DISULFID 6..11: note = Intrachain disulfide bond
  DISULFID 7: note = Interchain disulfide bond with the cysteine at position 13 of SEQ ID NO: 25501
  DISULFID 20: note = Interchain disulfide bond with the cysteine at position 25 of SEQ ID NO: 25501
GIVEQCCTSICSLYQLENYCN

SEQ ID NO: 25501 - protein, 35 aa, synthetic construct; identical to SEQ ID NO: 25228
  SITE 2: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)butanoic acid modified residue
  SITE 6: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)butanoic acid modified residue
  SITE 27: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)butanoic acid modified residue
  DISULFID 13: note = Interchain disulfide bond with the cysteine at position 7 of SEQ ID NO: 25500
  DISULFID 25: note = Interchain disulfide bond with the cysteine at position 20 of SEQ ID NO: 25500

SEQ ID NO: 25502 - protein, 21 aa, synthetic construct
  DISULFID 6..11: note = Intrachain disulfide bond
  DISULFID 7: note = Interchain disulfide bond with the cysteine at position 13 of SEQ ID NO: 25503
  DISULFID 20: note = Interchain disulfide bond with the cysteine at position 25 of SEQ ID NO: 25503
GIVEQCCTSICSLYQLENYCN

SEQ ID NO: 25503 - protein, 35 aa, synthetic construct; identical to SEQ ID NO: 25228
  SITE 2: note (S)-6-amino-3-((2S,3S)-2,3-bis(1-hydroxy-1,3-dihydrobenzo[c ][1,2]oxaborole-6-carboxamido)butanamido)-6-oxohexanoic acid modified residue
  SITE 6: note (S)-6-amino-3-((2S,3S)-2,3-bis(1-hydroxy-1,3-dihydrobenzo[c ][1,2]oxaborole-6-carboxamido)butanamido)-6-oxohexanoic acid modified residue
  SITE 27: note (S)-6-amino-3-((2S,3S)-2,3-bis(1-hydroxy-1,3-dihydrobenzo[c ][1,2]oxaborole-6-carboxamido)butanamido)-6-oxohexanoic acid modified residue
  DISULFID 13: note = Interchain disulfide bond with the cysteine at position 7 of SEQ ID NO: 25502
  DISULFID 25: note = Interchain disulfide bond with the cysteine at position 20 of SEQ ID NO: 25502

SEQ ID NO: 25504 - protein, 21 aa, synthetic construct
  DISULFID 6..11: note = Intrachain disulfide bond
  DISULFID 7: note = Interchain disulfide bond with the cysteine at position 13 of SEQ ID NO: 25505
  DISULFID 20: note = Interchain disulfide bond with the cysteine at position 25 of SEQ ID NO: 25505
GIVEQCCTSICSLYQLENYCN

SEQ ID NO: 25505 - protein, 35 aa, synthetic construct; identical to SEQ ID NO: 25228
  SITE 2: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 6: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 27: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 13: note = Interchain disulfide bond with the cysteine at position 7 of SEQ ID NO: 25504
  DISULFID 25: note = Interchain disulfide bond with the cysteine at position 20 of SEQ ID NO: 25504

SEQ ID NO: 25506 - protein, 21 aa, synthetic construct
  DISULFID 6..11: note = Intrachain disulfide bond
  DISULFID 7: note = Interchain disulfide bond with the cysteine at position 13 of SEQ ID NO: 25507
  DISULFID 20: note = Interchain disulfide bond with the cysteine at position 25 of SEQ ID NO: 25507
GIVEQCCTSICSLYQLENYCN

SEQ ID NO: 25507 - protein, 35 aa, synthetic construct; identical to SEQ ID NO: 25228
  SITE 2: note ((2S,3S)-2,3-bis(1-hydroxy-1,3-dihydrobenzo[c][1,2]oxaborol e-6-carboxamido)butanoyl)-L-aspartic acid modified residue
  SITE 6: note ((2S,3S)-2,3-bis(1-hydroxy-1,3-dihydrobenzo[c][1,2]oxaborol e-6-carboxamido)butanoyl)-L-aspartic acid modified residue
  SITE 27: note ((2S,3S)-2,3-bis(1-hydroxy-1,3-dihydrobenzo[c][1,2]oxaborol e-6-carboxamido)butanoyl)-L-aspartic acid modified residue
  DISULFID 13: note = Interchain disulfide bond with the cysteine at position 7 of SEQ ID NO: 25506
  DISULFID 25: note = Interchain disulfide bond with the cysteine at position 20 of SEQ ID NO: 25506

SEQ ID NO: 25508 - protein, 21 aa, synthetic construct
  DISULFID 6..11: note = Intrachain disulfide bond
  DISULFID 7: note = Interchain disulfide bond with the cysteine at position 13 of SEQ ID NO: 25509
  DISULFID 20: note = Interchain disulfide bond with the cysteine at position 25 of SEQ ID NO: 25509
GIVEQCCTSICSLYQLENYCN

SEQ ID NO: 25509 - protein, 35 aa, synthetic construct; identical to SEQ ID NO: 25228
  SITE 2: note 3-((2S,3S)-2,3-bis(1-hydroxy-1,3-dihydrobenzo[c][1,2]oxabor ole-6-carboxamido)-N-methylbutanamido)propanoic acid modified residue
  SITE 6: note 3-((2S,3S)-2,3-bis(1-hydroxy-1,3-dihydrobenzo[c][1,2]oxabor ole-6-carboxamido)-N-methylbutanamido)propanoic acid modified residue
  SITE 27: note 3-((2S,3S)-2,3-bis(1-hydroxy-1,3-dihydrobenzo[c][1,2]oxabor ole-6-carboxamido)-N-methylbutanamido)propanoic acid modified residue
  DISULFID 13: note = Interchain disulfide bond with the cysteine at position 7 of SEQ ID NO: 25508
  DISULFID 25: note = Interchain disulfide bond with the cysteine at position 20 of SEQ ID NO: 25508

SEQ ID NO: 25510 - protein, 21 aa, synthetic construct
  DISULFID 6..11: note = Intrachain disulfide bond
  DISULFID 7: note = Interchain disulfide bond with the cysteine at position 13 of SEQ ID NO: 25511
  DISULFID 20: note = Interchain disulfide bond with the cysteine at position 25 of SEQ ID NO: 25511
GIVEQCCTSICSLYQLENYCN

SEQ ID NO: 25511 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-hydroxyphe nyl)butanoic acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-hydroxyphe nyl)butanoic acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-hydroxyphe nyl)butanoic acid modified residue
  DISULFID 13: note = Interchain disulfide bond with the cysteine at position 7 of SEQ ID NO: 25510
  DISULFID 25: note = Interchain disulfide bond with the cysteine at position 20 of SEQ ID NO: 25510

SEQ ID NO: 25512 - protein, 21 aa, synthetic construct
  DISULFID 6..11: note = Intrachain disulfide bond
  DISULFID 7: note = Interchain disulfide bond with the cysteine at position 13 of SEQ ID NO: 25513
  DISULFID 20: note = Interchain disulfide bond with the cysteine at position 25 of SEQ ID NO: 25513
GIVEQCCTSICSLYQLENYCN

SEQ ID NO: 25513 - protein, 35 aa, synthetic construct; identical to SEQ ID NO: 25228
  SITE 2: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 6: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 27: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 13: note = Interchain disulfide bond with the cysteine at position 7 of SEQ ID NO: 25512
  DISULFID 25: note = Interchain disulfide bond with the cysteine at position 20 of SEQ ID NO: 25512

SEQ ID NO: 25514 - protein, 21 aa, synthetic construct
  DISULFID 6..11: note = Intrachain disulfide bond
  DISULFID 7: note = Interchain disulfide bond with the cysteine at position 13 of SEQ ID NO: 25515
  DISULFID 20: note = Interchain disulfide bond with the cysteine at position 25 of SEQ ID NO: 25515
GIVEQCCTSICSLYQLENYCN

SEQ ID NO: 25515 - protein, 35 aa, synthetic construct; identical to SEQ ID NO: 25228
  SITE 2: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-4-oxobu tanoic acid modified residue
  SITE 6: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-4-oxobu tanoic acid modified residue
  SITE 27: note (S)-4-amino-3-((2S,4R)-1-(1-hydroxy-1,3-dihydrobenzo[c][1,2 ]oxaborole-6-carbonyl)-4-(1-hydroxy-1,3-dihydrobenzo[c][1,2 ]oxaborole-6-carboxamido)pyrrolidine-2-carboxamido)-4-oxobu tanoic acid modified residue
  DISULFID 13: note = Interchain disulfide bond with the cysteine at position 7 of SEQ ID NO: 25514
  DISULFID 25: note = Interchain disulfide bond with the cysteine at position 20 of SEQ ID NO: 25514

SEQ ID NO: 25516 - protein, 21 aa, synthetic construct
  DISULFID 6..11: note = Intrachain disulfide bond
  DISULFID 7: note = Interchain disulfide bond with the cysteine at position 13 of SEQ ID NO: 25517
  DISULFID 20: note = Interchain disulfide bond with the cysteine at position 25 of SEQ ID NO: 25517
GIVEQCCTSICSLYQLENYCN

SEQ ID NO: 25517 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-methoxyphe nyl)propanoic acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-methoxyphe nyl)propanoic acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(4-methoxyphe nyl)propanoic acid modified residue
  DISULFID 13: note = Interchain disulfide bond with the cysteine at position 7 of SEQ ID NO: 25516
  DISULFID 25: note = Interchain disulfide bond with the cysteine at position 20 of SEQ ID NO: 25516

SEQ ID NO: 25518 - protein, 21 aa, synthetic construct
  DISULFID 6..11: note = Intrachain disulfide bond
  DISULFID 7: note = Interchain disulfide bond with the cysteine at position 13 of SEQ ID NO: 25519
  DISULFID 20: note = Interchain disulfide bond with the cysteine at position 25 of SEQ ID NO: 25519
GIVEQCCTSICSLYQLENYCN

SEQ ID NO: 25519 - protein, 35 aa, synthetic construct; identical to SEQ ID NO: 25228
  SITE 2: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  SITE 6: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  SITE 27: note (S)-4-hydroxy-3-((2S,4R)-1-(1-hydroxy-1,3-dihydrobenzo[c][1 ,2]oxaborole-6-carbonyl)-4-(1-hydroxy-1,3-dihydrobenzo[c][1 ,2]oxaborole-6-carboxamido)pyrrolidine-2-carboxamido)butano ic acid modified residue
  DISULFID 13: note = Interchain disulfide bond with the cysteine at position 7 of SEQ ID NO: 25518
  DISULFID 25: note = Interchain disulfide bond with the cysteine at position 20 of SEQ ID NO: 25518

SEQ ID NO: 25520 - protein, 21 aa, synthetic construct
  DISULFID 6..11: note = Intrachain disulfide bond
  DISULFID 7: note = Interchain disulfide bond with the cysteine at position 13 of SEQ ID NO: 25521
  DISULFID 20: note = Interchain disulfide bond with the cysteine at position 25 of SEQ ID NO: 25521
GIVEQCCTSICSLYQLENYCN

SEQ ID NO: 25521 - protein, 35 aa, synthetic construct; identical to SEQ ID NO: 25228
  SITE 2: note (R)-3-((2S,3S)-2,3-bis(1-hydroxy-1,3-dihydrobenzo[c][1,2]ox aborole-6-carboxamido)butanamido)-4-(perfluorophenyl)butano ic acid modified residue
  SITE 6: note (R)-3-((2S,3S)-2,3-bis(1-hydroxy-1,3-dihydrobenzo[c][1,2]ox aborole-6-carboxamido)butanamido)-4-(perfluorophenyl)butano ic acid modified residue
  SITE 27: note (R)-3-((2S,3S)-2,3-bis(1-hydroxy-1,3-dihydrobenzo[c][1,2]ox aborole-6-carboxamido)butanamido)-4-(perfluorophenyl)butano ic acid modified residue
  DISULFID 13: note = Interchain disulfide bond with the cysteine at position 7 of SEQ ID NO: 25520
  DISULFID 25: note = Interchain disulfide bond with the cysteine at position 20 of SEQ ID NO: 25520

SEQ ID NO: 25522 - protein, 21 aa, synthetic construct
  DISULFID 6..11: note = Intrachain disulfide bond
  DISULFID 7: note = Interchain disulfide bond with the cysteine at position 13 of SEQ ID NO: 25523
  DISULFID 20: note = Interchain disulfide bond with the cysteine at position 25 of SEQ ID NO: 25523
GIVEQCCTSICSLYQLENYCN

SEQ ID NO: 25523 - protein, 35 aa, synthetic construct; identical to SEQ ID NO: 25228
  SITE 2: note 2-((2S)-1-((2S,3S)-2,3-bis(1-hydroxy-1,3-dihydrobenzo[c][1, 2]oxaborole-6-carboxamido)butanoyl)-4-hydroxypyrrolidin-2-y l)acetic acid modified residue
  SITE 6: note 2-((2S)-1-((2S,3S)-2,3-bis(1-hydroxy-1,3-dihydrobenzo[c][1, 2]oxaborole-6-carboxamido)butanoyl)-4-hydroxypyrrolidin-2-y l)acetic acid modified residue
  SITE 27: note 2-((2S)-1-((2S,3S)-2,3-bis(1-hydroxy-1,3-dihydrobenzo[c][1, 2]oxaborole-6-carboxamido)butanoyl)-4-hydroxypyrrolidin-2-y l)acetic acid modified residue
  DISULFID 13: note = Interchain disulfide bond with the cysteine at position 7 of SEQ ID NO: 25522
  DISULFID 25: note = Interchain disulfide bond with the cysteine at position 20 of SEQ ID NO: 25522

SEQ ID NO: 25524 - protein, 21 aa, synthetic construct
  DISULFID 6..11: note = Intrachain disulfide bond
  DISULFID 7: note = Interchain disulfide bond with the cysteine at position 13 of SEQ ID NO: 25525
  DISULFID 20: note = Interchain disulfide bond with the cysteine at position 25 of SEQ ID NO: 25525
GIVEQCCTSICSLYQLENYCN

SEQ ID NO: 25525 - protein, 35 aa, synthetic construct; identical to SEQ ID NO: 25228
  SITE 2: note (R)-4-(4-cyanophenyl)-3-((2S,4R)-1-(1-hydroxy-1,3-dihydrobe nzo[c][1,2]oxaborole-6-carbonyl)-4-(1-hydroxy-1,3-dihydrobe nzo[c][1,2]oxaborole-6-carboxamido)pyrrolidine-2-carboxamid o)butanoic acid modified residue
  SITE 6: note (R)-4-(4-cyanophenyl)-3-((2S,4R)-1-(1-hydroxy-1,3-dihydrobe nzo[c][1,2]oxaborole-6-carbonyl)-4-(1-hydroxy-1,3-dihydrobe nzo[c][1,2]oxaborole-6-carboxamido)pyrrolidine-2-carboxamid o)butanoic acid modified residue
  SITE 27: note (R)-4-(4-cyanophenyl)-3-((2S,4R)-1-(1-hydroxy-1,3-dihydrobe nzo[c][1,2]oxaborole-6-carbonyl)-4-(1-hydroxy-1,3-dihydrobe nzo[c][1,2]oxaborole-6-carboxamido)pyrrolidine-2-carboxamid o)butanoic acid modified residue
  DISULFID 13: note = Interchain disulfide bond with the cysteine at position 7 of SEQ ID NO: 25524
  DISULFID 25: note = Interchain disulfide bond with the cysteine at position 20 of SEQ ID NO: 25524

SEQ ID NO: 25526 - protein, 21 aa, synthetic construct
  DISULFID 6..11: note = Intrachain disulfide bond
  DISULFID 7: note = Interchain disulfide bond with the cysteine at position 13 of SEQ ID NO: 25527
  DISULFID 20: note = Interchain disulfide bond with the cysteine at position 25 of SEQ ID NO: 25527
GIVEQCCTSICSLYQLENYCN

SEQ ID NO: 25527 - protein, 35 aa, synthetic construct; identical to SEQ ID NO: 25228
  SITE 2: note 2-(4-((2S,3S)-2,3-bis(1-hydroxy-1,3-dihydrobenzo[c][1,2]oxa borole-6-carboxamido)butanamido)piperidin-4-yl)acetic acid modified residue
  SITE 6: note 2-(4-((2S,3S)-2,3-bis(1-hydroxy-1,3-dihydrobenzo[c][1,2]oxa borole-6-carboxamido)butanamido)piperidin-4-yl)acetic acid modified residue
  SITE 27: note 2-(4-((2S,3S)-2,3-bis(1-hydroxy-1,3-dihydrobenzo[c][1,2]oxa borole-6-carboxamido)butanamido)piperidin-4-yl)acetic acid modified residue
  DISULFID 13: note = Interchain disulfide bond with the cysteine at position 7 of SEQ ID NO: 25526
  DISULFID 25: note = Interchain disulfide bond with the cysteine at position 20 of SEQ ID NO: 25526

SEQ ID NO: 25528 - protein, 21 aa, synthetic construct
  DISULFID 6..11: note = Intrachain disulfide bond
  DISULFID 7: note = Interchain disulfide bond with the cysteine at position 13 of SEQ ID NO: 25529
  DISULFID 20: note = Interchain disulfide bond with the cysteine at position 25 of SEQ ID NO: 25529
GIVEQCCTSICSLYQLENYCN

SEQ ID NO: 25529 - protein, 35 aa, synthetic construct; identical to SEQ ID NO: 25228
  SITE 2: note 2-(1-((2S,4S)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)cyclopentyl)aceti c acid modified residue
  SITE 6: note 2-(1-((2S,4S)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)cyclopentyl)aceti c acid modified residue
  SITE 27: note 2-(1-((2S,4S)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)cyclopentyl)aceti c acid modified residue
  DISULFID 13: note = Interchain disulfide bond with the cysteine at position 7 of SEQ ID NO: 25528
  DISULFID 25: note = Interchain disulfide bond with the cysteine at position 20 of SEQ ID NO: 25528

SEQ ID NO: 25530 - protein, 21 aa, synthetic construct
  DISULFID 6..11: note = Intrachain disulfide bond
  DISULFID 7: note = Interchain disulfide bond with the cysteine at position 9 of SEQ ID NO: 25531
  DISULFID 20: note = Interchain disulfide bond with the cysteine at position 21 of SEQ ID NO: 25531
GIVEQCCTSICSLYQLENYCG

SEQ ID NO: 25531 - protein, 31 aa, synthetic construct; identical to SEQ ID NO: 24063
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 23: note 3-((2S,3S)-2,3-bis(1-hydroxy-1,3-dihydrobenzo[c][1,2]oxabor ole-6-carboxamido)butanamido)propanoic acid modified residue
  DISULFID 9: note = Interchain disulfide bond with the cysteine at position 7 of SEQ ID NO: 25530
  DISULFID 21: note = Interchain disulfide bond with the cysteine at position 20 of SEQ ID NO: 25530

SEQ ID NO: 25532 - protein, 21 aa, synthetic construct
  DISULFID 6..11: note = Intrachain disulfide bond
  DISULFID 7: note = Interchain disulfide bond with the cysteine at position 13 of SEQ ID NO: 25533
  DISULFID 20: note = Interchain disulfide bond with the cysteine at position 25 of SEQ ID NO: 25533
GIVEQCCTSICSLYQLENYCN

SEQ ID NO: 25533 - protein, 35 aa, synthetic construct; identical to SEQ ID NO: 25228
  SITE 2: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  SITE 6: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  SITE 27: note (3S,4R)-3-((2S,3S)-2,3-bis(1-hydroxy-1,3-dihydrobenzo[c][1, 2]oxaborole-6-carboxamido)butanamido)-4-hydroxypentanoic acid modified residue
  DISULFID 13: note = Interchain disulfide bond with the cysteine at position 7 of SEQ ID NO: 25532
  DISULFID 25: note = Interchain disulfide bond with the cysteine at position 20 of SEQ ID NO: 25532

SEQ ID NO: 25534 - protein, 21 aa, synthetic construct
  DISULFID 6..11: note = Intrachain disulfide bond
  DISULFID 7: note = Interchain disulfide bond with the cysteine at position 13 of SEQ ID NO: 25535
  DISULFID 20: note = Interchain disulfide bond with the cysteine at position 25 of SEQ ID NO: 25535
GIVEQCCTSICSLYQLENYCN

SEQ ID NO: 25535 - protein, 35 aa, synthetic construct; identical to SEQ ID NO: 25228
  SITE 2: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(perfluorophe nyl)butanoic acid modified residue
  SITE 6: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(perfluorophe nyl)butanoic acid modified residue
  SITE 27: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(perfluorophe nyl)butanoic acid modified residue
  DISULFID 13: note = Interchain disulfide bond with the cysteine at position 7 of SEQ ID NO: 25534
  DISULFID 25: note = Interchain disulfide bond with the cysteine at position 20 of SEQ ID NO: 25534

SEQ ID NO: 25536 - protein, 21 aa, synthetic construct
  DISULFID 6..11: note = Intrachain disulfide bond
  DISULFID 7: note = Interchain disulfide bond with the cysteine at position 13 of SEQ ID NO: 25537
  DISULFID 20: note = Interchain disulfide bond with the cysteine at position 25 of SEQ ID NO: 25537
GIVEQCCTSICSLYQLENYCN

SEQ ID NO: 25537 - protein, 35 aa, synthetic construct; identical to SEQ ID NO: 25228
  SITE 2: note 2-((2S)-4-hydroxy-1-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carbonyl)pyrro lidin-2-yl)acetic acid modified residue
  SITE 6: note 2-((2S)-4-hydroxy-1-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carbonyl)pyrro lidin-2-yl)acetic acid modified residue
  SITE 27: note 2-((2S)-4-hydroxy-1-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carbonyl)pyrro lidin-2-yl)acetic acid modified residue
  DISULFID 13: note = Interchain disulfide bond with the cysteine at position 7 of SEQ ID NO: 25536
  DISULFID 25: note = Interchain disulfide bond with the cysteine at position 20 of SEQ ID NO: 25536

SEQ ID NO: 25538 - protein, 21 aa, synthetic construct
  DISULFID 6..11: note = Intrachain disulfide bond
  DISULFID 7: note = Interchain disulfide bond with the cysteine at position 13 of SEQ ID NO: 25539
  DISULFID 20: note = Interchain disulfide bond with the cysteine at position 25 of SEQ ID NO: 25539
GIVEQCCTSICSLYQLENYCN

SEQ ID NO: 25539 - protein, 35 aa, synthetic construct; identical to SEQ ID NO: 25228
  SITE 2: note 2-((S)-1-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)piperidin-2-yl)a cetic acid modified residue
  SITE 6: note 2-((S)-1-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)piperidin-2-yl)a cetic acid modified residue
  SITE 27: note 2-((S)-1-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)piperidin-2-yl)a cetic acid modified residue
  DISULFID 13: note = Interchain disulfide bond with the cysteine at position 7 of SEQ ID NO: 25538
  DISULFID 25: note = Interchain disulfide bond with the cysteine at position 20 of SEQ ID NO: 25538

SEQ ID NO: 25540 - protein, 21 aa, synthetic construct
  DISULFID 6..11: note = Intrachain disulfide bond
  DISULFID 7: note = Interchain disulfide bond with the cysteine at position 13 of SEQ ID NO: 25541
  DISULFID 20: note = Interchain disulfide bond with the cysteine at position 25 of SEQ ID NO: 25541
GIVEQCCTSICSLYQLENYCN

SEQ ID NO: 25541 - protein, 35 aa, synthetic construct; identical to SEQ ID NO: 25228
  SITE 2: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  SITE 6: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  SITE 27: note 2-(4-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)piperidin-4-yl)ac etic acid modified residue
  DISULFID 13: note = Interchain disulfide bond with the cysteine at position 7 of SEQ ID NO: 25540
  DISULFID 25: note = Interchain disulfide bond with the cysteine at position 20 of SEQ ID NO: 25540

SEQ ID NO: 25542 - protein, 21 aa, synthetic construct
  DISULFID 6..11: note = Intrachain disulfide bond
  DISULFID 7: note = Interchain disulfide bond with the cysteine at position 13 of SEQ ID NO: 25543
  DISULFID 20: note = Interchain disulfide bond with the cysteine at position 25 of SEQ ID NO: 25543
GIVEQCCTSICSLYQLENYCG

SEQ ID NO: 25543 - protein, 35 aa, synthetic construct; identical to SEQ ID NO: 25228
  SITE 2: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 6: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  SITE 27: note (1S,2S)-2-((2S,3S)-2,3-bis(1-hydroxy-1,3-dihydrobenzo[c][1, 2]oxaborole-6-carboxamido)butanamido)cyclopentane-1-carboxy lic acid modified residue
  DISULFID 13: note = Interchain disulfide bond with the cysteine at position 7 of SEQ ID NO: 25542
  DISULFID 25: note = Interchain disulfide bond with the cysteine at position 20 of SEQ ID NO: 25542

SEQ ID NO: 25544 - protein, 21 aa, synthetic construct
  DISULFID 6..11: note = Intrachain disulfide bond
  DISULFID 7: note = Interchain disulfide bond with the cysteine at position 13 of SEQ ID NO: 25545
  DISULFID 20: note = Interchain disulfide bond with the cysteine at position 25 of SEQ ID NO: 25545
GIVEQCCTSICSLYQLENYCN

SEQ ID NO: 25545 - protein, 35 aa, synthetic construct; identical to SEQ ID NO: 25228
  SITE 2: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 6: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 27: note 3-((2S,3S)-2,3-bis(4-fluoro-1-hydroxy-1,3-dihydrobenzo[c][1 ,2]oxaborole-6-carboxamido)butanamido)propanoic acid modified residue
  DISULFID 13: note = Interchain disulfide bond with the cysteine at position 7 of SEQ ID NO: 25544
  DISULFID 25: note = Interchain disulfide bond with the cysteine at position 20 of SEQ ID NO: 25544

SEQ ID NO: 25546 - protein, 21 aa, synthetic construct
  DISULFID 6..11: note = Intrachain disulfide bond
  DISULFID 7: note = Interchain disulfide bond with the cysteine at position 13 of SEQ ID NO: 25547
  DISULFID 20: note = Interchain disulfide bond with the cysteine at position 25 of SEQ ID NO: 25547
GIVEQCCTSICSLYQLENYCN

SEQ ID NO: 25547 - protein, 35 aa, synthetic construct; identical to SEQ ID NO: 25228
  SITE 2: note (3S,4R)-4-hydroxy-3-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carboxamido)pe ntanoic acid modified residue
  SITE 6: note (3S,4R)-4-hydroxy-3-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carboxamido)pe ntanoic acid modified residue
  SITE 27: note (3S,4R)-4-hydroxy-3-((2S,4R)-1-(1-hydroxy-1,3-dihydrobenzo[ c][1,2]oxaborole-6-carbonyl)-4-(1-hydroxy-1,3-dihydrobenzo[ c][1,2]oxaborole-6-carboxamido)pyrrolidine-2-carboxamido)pe ntanoic acid modified residue
  DISULFID 13: note = Interchain disulfide bond with the cysteine at position 7 of SEQ ID NO: 25546
  DISULFID 25: note = Interchain disulfide bond with the cysteine at position 20 of SEQ ID NO: 25546

SEQ ID NO: 25548 - protein, 21 aa, synthetic construct
  DISULFID 6..11: note = Intrachain disulfide bond
  DISULFID 7: note = Interchain disulfide bond with the cysteine at position 13 of SEQ ID NO: 25549
  DISULFID 20: note = Interchain disulfide bond with the cysteine at position 25 of SEQ ID NO: 25549
GIVEQCCTSICSLYQLENYCN

SEQ ID NO: 25549 - protein, 35 aa, synthetic construct; identical to SEQ ID NO: 25228
  SITE 2: note (S)-4,4,4-trifluoro-3-((2S,4R)-1-(1-hydroxy-1,3-dihydrobenz o[c][1,2]oxaborole-6-carbonyl)-4-(1-hydroxy-1,3-dihydrobenz o[c][1,2]oxaborole-6-carboxamido)pyrrolidine-2-carboxamido) butanoic acid modified residue
  SITE 6: note (S)-4,4,4-trifluoro-3-((2S,4R)-1-(1-hydroxy-1,3-dihydrobenz o[c][1,2]oxaborole-6-carbonyl)-4-(1-hydroxy-1,3-dihydrobenz o[c][1,2]oxaborole-6-carboxamido)pyrrolidine-2-carboxamido) butanoic acid modified residue
  SITE 27: note (S)-4,4,4-trifluoro-3-((2S,4R)-1-(1-hydroxy-1,3-dihydrobenz o[c][1,2]oxaborole-6-carbonyl)-4-(1-hydroxy-1,3-dihydrobenz o[c][1,2]oxaborole-6-carboxamido)pyrrolidine-2-carboxamido) butanoic acid modified residue
  DISULFID 13: note = Interchain disulfide bond with the cysteine at position 7 of SEQ ID NO: 25548
  DISULFID 25: note = Interchain disulfide bond with the cysteine at position 20 of SEQ ID NO: 25548

SEQ ID NO: 25550 - protein, 21 aa, synthetic construct
  DISULFID 6..11: note = Intrachain disulfide bond
  DISULFID 7: note = Interchain disulfide bond with the cysteine at position 13 of SEQ ID NO: 25551
  DISULFID 20: note = Interchain disulfide bond with the cysteine at position 25 of SEQ ID NO: 25551
GIVEQCCTSICSLYQLENYCN

SEQ ID NO: 25551 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  DISULFID 13: note = Interchain disulfide bond with the cysteine at position 7 of SEQ ID NO: 25550
  DISULFID 25: note = Interchain disulfide bond with the cysteine at position 20 of SEQ ID NO: 25550

SEQ ID NO: 25552 - protein, 21 aa, synthetic construct
  DISULFID 6..11: note = Intrachain disulfide bond
  DISULFID 7: note = Interchain disulfide bond with the cysteine at position 13 of SEQ ID NO: 25553
  DISULFID 20: note = Interchain disulfide bond with the cysteine at position 25 of SEQ ID NO: 25553
GIVEQCCTSICSLYQLENYCG

SEQ ID NO: 25553 - protein, 35 aa, synthetic construct; identical to SEQ ID NO: 25228
  SITE 2: note (S)-3-((2S,3S)-2,3-bis(1-hydroxy-1,3-dihydrobenzo[c][1,2]ox aborole-6-carboxamido)butanamido)hexanedioic acid modified residue
  SITE 6: note (S)-3-((2S,3S)-2,3-bis(1-hydroxy-1,3-dihydrobenzo[c][1,2]ox aborole-6-carboxamido)butanamido)hexanedioic acid modified residue
  SITE 27: note (S)-3-((2S,3S)-2,3-bis(1-hydroxy-1,3-dihydrobenzo[c][1,2]ox aborole-6-carboxamido)butanamido)hexanedioic acid modified residue
  DISULFID 13: note = Interchain disulfide bond with the cysteine at position 7 of SEQ ID NO: 25552
  DISULFID 25: note = Interchain disulfide bond with the cysteine at position 20 of SEQ ID NO: 25552

SEQ ID NO: 25554 - protein, 21 aa, synthetic construct
  DISULFID 6..11: note = Intrachain disulfide bond
  DISULFID 7: note = Interchain disulfide bond with the cysteine at position 13 of SEQ ID NO: 25555
  DISULFID 20: note = Interchain disulfide bond with the cysteine at position 25 of SEQ ID NO: 25555
GIVEQCCTSICSLYQLENYCG

SEQ ID NO: 25555 - protein, 35 aa, synthetic construct; identical to SEQ ID NO: 25228
  SITE 2: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 6: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  SITE 27: note 2-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)cyclopentane-1-carbo xylic acid modified residue
  DISULFID 13: note = Interchain disulfide bond with the cysteine at position 7 of SEQ ID NO: 25554
  DISULFID 25: note = Interchain disulfide bond with the cysteine at position 20 of SEQ ID NO: 25554

SEQ ID NO: 25556 - protein, 21 aa, synthetic construct
  DISULFID 6..11: note = Intrachain disulfide bond
  DISULFID 7: note = Interchain disulfide bond with the cysteine at position 8 of SEQ ID NO: 25557
  DISULFID 20: note = Interchain disulfide bond with the cysteine at position 20 of SEQ ID NO: 25557
GIVEQCCTSICSLYQLENYCN

SEQ ID NO: 25557 - protein, 31 aa, synthetic construct; identical to SEQ ID NO: 24060
  SITE 1: note (R)-3-(3,4-bis(1-hydroxy-1,3-dihydrobenzo[c][1,2]oxaborole- 6-carboxamido)butanamido)propanoic acid modified residue
  SITE 22: note (R)-3-(3,4-bis(1-hydroxy-1,3-dihydrobenzo[c][1,2]oxaborole- 6-carboxamido)butanamido)propanoic acid modified residue
  SITE 30: note (R)-3-(3,4-bis(1-hydroxy-1,3-dihydrobenzo[c][1,2]oxaborole- 6-carboxamido)butanamido)propanoic acid modified residue
  DISULFID 8: note = Interchain disulfide bond with the cysteine at position 7 of SEQ ID NO: 25556
  DISULFID 20: note = Interchain disulfide bond with the cysteine at position 20 of SEQ ID NO: 25556

SEQ ID NO: 25558 - protein, 21 aa, synthetic construct
  DISULFID 6..11: note = Intrachain disulfide bond
  DISULFID 7: note = Interchain disulfide bond with the cysteine at position 13 of SEQ ID NO: 25559
  DISULFID 20: note = Interchain disulfide bond with the cysteine at position 25 of SEQ ID NO: 25559
GIVEQCCTSICSLYQLENYCN

SEQ ID NO: 25559 - protein, 35 aa, synthetic construct; identical to SEQ ID NO: 25228
  SITE 2: note 2-(1-((2S,3S)-2,3-bis(1-hydroxy-1,3-dihydrobenzo[c][1,2]oxa borole-6-carboxamido)butanamido)cyclopentyl)acetic acid modified residue
  SITE 6: note 2-(1-((2S,3S)-2,3-bis(1-hydroxy-1,3-dihydrobenzo[c][1,2]oxa borole-6-carboxamido)butanamido)cyclopentyl)acetic acid modified residue
  SITE 27: note 2-(1-((2S,3S)-2,3-bis(1-hydroxy-1,3-dihydrobenzo[c][1,2]oxa borole-6-carboxamido)butanamido)cyclopentyl)acetic acid modified residue
  DISULFID 13: note = Interchain disulfide bond with the cysteine at position 7 of SEQ ID NO: 25558
  DISULFID 25: note = Interchain disulfide bond with the cysteine at position 20 of SEQ ID NO: 25558

SEQ ID NO: 25560 - protein, 21 aa, synthetic construct
  DISULFID 6..11: note = Intrachain disulfide bond
  DISULFID 7: note = Interchain disulfide bond with the cysteine at position 13 of SEQ ID NO: 25561
  DISULFID 20: note = Interchain disulfide bond with the cysteine at position 25 of SEQ ID NO: 25561
GIVEQCCTSICSLYQLENYCN

SEQ ID NO: 25561 - protein, 35 aa, synthetic construct; identical to SEQ ID NO: 25228
  SITE 2: note (1S,2S)-2-((2S,3S)-2,3-bis(1-hydroxy-1,3-dihydrobenzo[c][1, 2]oxaborole-6-carboxamido)butanamido)cyclohexane-1-carboxyl ic acid modified residue
  SITE 6: note (1S,2S)-2-((2S,3S)-2,3-bis(1-hydroxy-1,3-dihydrobenzo[c][1, 2]oxaborole-6-carboxamido)butanamido)cyclohexane-1-carboxyl ic acid modified residue
  SITE 27: note (1S,2S)-2-((2S,3S)-2,3-bis(1-hydroxy-1,3-dihydrobenzo[c][1, 2]oxaborole-6-carboxamido)butanamido)cyclohexane-1-carboxyl ic acid modified residue
  DISULFID 13: note = Interchain disulfide bond with the cysteine at position 7 of SEQ ID NO: 25560
  DISULFID 25: note = Interchain disulfide bond with the cysteine at position 20 of SEQ ID NO: 25560

SEQ ID NO: 25562 - protein, 21 aa, synthetic construct
  DISULFID 6..11: note = Intrachain disulfide bond
  DISULFID 7: note = Interchain disulfide bond with the cysteine at position 13 of SEQ ID NO: 25563
  DISULFID 20: note = Interchain disulfide bond with the cysteine at position 25 of SEQ ID NO: 25563
GIVEQCCTSICSLYQLENYCN

SEQ ID NO: 25563 - protein, 35 aa, synthetic construct; identical to SEQ ID NO: 25228
  SITE 2: note 2-((S)-1-((2S,3S)-2,3-bis(1-hydroxy-1,3-dihydrobenzo[c][1,2 ]oxaborole-6-carboxamido)butanoyl)pyrrolidin-2-yl)acetic acid modified residue
  SITE 6: note 2-((S)-1-((2S,3S)-2,3-bis(1-hydroxy-1,3-dihydrobenzo[c][1,2 ]oxaborole-6-carboxamido)butanoyl)pyrrolidin-2-yl)acetic acid modified residue
  SITE 27: note 2-((S)-1-((2S,3S)-2,3-bis(1-hydroxy-1,3-dihydrobenzo[c][1,2 ]oxaborole-6-carboxamido)butanoyl)pyrrolidin-2-yl)acetic acid modified residue
  DISULFID 13: note = Interchain disulfide bond with the cysteine at position 7 of SEQ ID NO: 25562
  DISULFID 25: note = Interchain disulfide bond with the cysteine at position 20 of SEQ ID NO: 25562

SEQ ID NO: 25564 - protein, 21 aa, synthetic construct
  DISULFID 6..11: note = Intrachain disulfide bond
  DISULFID 7: note = Interchain disulfide bond with the cysteine at position 13 of SEQ ID NO: 25565
  DISULFID 20: note = Interchain disulfide bond with the cysteine at position 25 of SEQ ID NO: 25565
GIVEQCCTSICSLYQLENYCN

SEQ ID NO: 25565 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)hexanedioic acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)hexanedioic acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)hexanedioic acid modified residue
  DISULFID 13: note = Interchain disulfide bond with the cysteine at position 7 of SEQ ID NO: 25564
  DISULFID 25: note = Interchain disulfide bond with the cysteine at position 20 of SEQ ID NO: 25564

SEQ ID NO: 25566 - protein, 21 aa, synthetic construct
  DISULFID 6..11: note = Intrachain disulfide bond
  DISULFID 7: note = Interchain disulfide bond with the cysteine at position 13 of SEQ ID NO: 25567
  DISULFID 20: note = Interchain disulfide bond with the cysteine at position 25 of SEQ ID NO: 25567
GIVEQCCTSICSLYQLENYCN

SEQ ID NO: 25567 - protein, 35 aa, synthetic construct; identical to SEQ ID NO: 25228
  SITE 2: note 3-((S)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carboxamido)-6-octanamido hexanamido)propanoic acid modified residue
  SITE 6: note 3-((S)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carboxamido)-6-octanamido hexanamido)propanoic acid modified residue
  SITE 27: note 3-((S)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carboxamido)-6-octanamido hexanamido)propanoic acid modified residue
  DISULFID 13: note = Interchain disulfide bond with the cysteine at position 7 of SEQ ID NO: 25566
  DISULFID 25: note = Interchain disulfide bond with the cysteine at position 20 of SEQ ID NO: 25566

SEQ ID NO: 25568 - protein, 22 aa, synthetic construct
  SITE 22: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  DISULFID 6..11: note = Intrachain disulfide bond
  DISULFID 7: note = Interchain disulfide bond with the cysteine at position 12 of SEQ ID NO: 25569
  DISULFID 20: note = Interchain disulfide bond with the cysteine at position 24 of SEQ ID NO: 25569
GIVEQCCTSICSLYQLENYCGK

SEQ ID NO: 25569 - protein, 34 aa, synthetic construct; identical to SEQ ID NO: 25393
  SITE 1: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 5: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  SITE 26: note 3-((2S,4R)-1-(1-hydroxy-1,3-dihydrobenzo[c][1,2]oxaborole-6 -carbonyl)-4-(1-hydroxy-1,3-dihydrobenzo[c][1,2]oxaborole-6 -carboxamido)pyrrolidine-2-carboxamido)propanoic acid modified residue
  DISULFID 12: note = Interchain disulfide bond with the cysteine at position 7 of SEQ ID NO: 25568
  DISULFID 24: note = Interchain disulfide bond with the cysteine at position 20 of SEQ ID NO: 25568

SEQ ID NO: 25570 - protein, 22 aa, synthetic construct
  SITE 22: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  DISULFID 6..11: note = Intrachain disulfide bond
  DISULFID 7: note = Interchain disulfide bond with the cysteine at position 12 of SEQ ID NO: 25571
  DISULFID 20: note = Interchain disulfide bond with the cysteine at position 24 of SEQ ID NO: 25571
GIVEQCCTSICSLYQLENYCGK

SEQ ID NO: 25571 - protein, 34 aa, synthetic construct; identical to SEQ ID NO: 25393
  SITE 1: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 5: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 26: note 3-((2S,4R)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  DISULFID 12: note = Interchain disulfide bond with the cysteine at position 7 of SEQ ID NO: 25570
  DISULFID 24: note = Interchain disulfide bond with the cysteine at position 20 of SEQ ID NO: 25570

SEQ ID NO: 25572 - protein, 22 aa, synthetic construct
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 6..11: note = Intrachain disulfide bond
  DISULFID 7: note = Interchain disulfide bond with the cysteine at position 12 of SEQ ID NO: 25573
  DISULFID 20: note = Interchain disulfide bond with the cysteine at position 24 of SEQ ID NO: 25573
GIVEQCCTSICSLYQLENYCGK

SEQ ID NO: 25573 - protein, 34 aa, synthetic construct; identical to SEQ ID NO: 25393
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 5: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 26: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 12: note = Interchain disulfide bond with the cysteine at position 7 of SEQ ID NO: 25572
  DISULFID 24: note = Interchain disulfide bond with the cysteine at position 20 of SEQ ID NO: 25572

SEQ ID NO: 25574 - protein, 22 aa, synthetic construct
  SITE 22: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-aspa rtic acid modified residue
  DISULFID 6..11: note = Intrachain disulfide bond
  DISULFID 7: note = Interchain disulfide bond with the cysteine at position 12 of SEQ ID NO: 25575
  DISULFID 20: note = Interchain disulfide bond with the cysteine at position 24 of SEQ ID NO: 25575
GIVEQCCTSICSLYQLENYCGK

SEQ ID NO: 25575 - protein, 34 aa, synthetic construct; identical to SEQ ID NO: 25393
  SITE 1: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-aspa rtic acid modified residue
  SITE 5: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-aspa rtic acid modified residue
  SITE 26: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-aspa rtic acid modified residue
  DISULFID 12: note = Interchain disulfide bond with the cysteine at position 7 of SEQ ID NO: 25574
  DISULFID 24: note = Interchain disulfide bond with the cysteine at position 20 of SEQ ID NO: 25574

SEQ ID NO: 25576 - protein, 22 aa, synthetic construct
  SITE 22: note ((2S,3S)-2,3-bis(1-hydroxy-1,3-dihydrobenzo[c][1,2]oxaborol e-6-carboxamido)butanoyl)-L-glutamic acid modified residue
  DISULFID 6..11: note = Intrachain disulfide bond
  DISULFID 7: note = Interchain disulfide bond with the cysteine at position 12 of SEQ ID NO: 25577
  DISULFID 20: note = Interchain disulfide bond with the cysteine at position 24 of SEQ ID NO: 25577
GIVEQCCTSICSLYQLENYCGK

SEQ ID NO: 25577 - protein, 34 aa, synthetic construct; identical to SEQ ID NO: 25393
  SITE 1: note ((2S,3S)-2,3-bis(1-hydroxy-1,3-dihydrobenzo[c][1,2]oxaborol e-6-carboxamido)butanoyl)-L-glutamic acid modified residue
  SITE 5: note ((2S,3S)-2,3-bis(1-hydroxy-1,3-dihydrobenzo[c][1,2]oxaborol e-6-carboxamido)butanoyl)-L-glutamic acid modified residue
  SITE 26: note ((2S,3S)-2,3-bis(1-hydroxy-1,3-dihydrobenzo[c][1,2]oxaborol e-6-carboxamido)butanoyl)-L-glutamic acid modified residue
  DISULFID 12: note = Interchain disulfide bond with the cysteine at position 7 of SEQ ID NO: 25576
  DISULFID 24: note = Interchain disulfide bond with the cysteine at position 20 of SEQ ID NO: 25576

SEQ ID NO: 25578 - protein, 22 aa, synthetic construct
  SITE 22: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  DISULFID 6..11: note = Intrachain disulfide bond
  DISULFID 7: note = Interchain disulfide bond with the cysteine at position 12 of SEQ ID NO: 25579
  DISULFID 20: note = Interchain disulfide bond with the cysteine at position 24 of SEQ ID NO: 25579
GIVEQCCTSICSLYQLENYCGK

SEQ ID NO: 25579 - protein, 34 aa, synthetic construct; identical to SEQ ID NO: 25393
  SITE 1: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  SITE 5: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  SITE 26: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  DISULFID 12: note = Interchain disulfide bond with the cysteine at position 7 of SEQ ID NO: 25578
  DISULFID 24: note = Interchain disulfide bond with the cysteine at position 20 of SEQ ID NO: 25578

SEQ ID NO: 25580 - protein, 22 aa, synthetic construct
  SITE 22: note ((2S,3S)-2,3-bis(1-hydroxy-1,3-dihydrobenzo[c][1,2]oxaborol e-6-carboxamido)butanoyl)-L-glutamic acid modified residue
  DISULFID 6..11: note = Intrachain disulfide bond
  DISULFID 7: note = Interchain disulfide bond with the cysteine at position 8 of SEQ ID NO: 25581
  DISULFID 20: note = Interchain disulfide bond with the cysteine at position 20 of SEQ ID NO: 25581
GIVEQCCTSICSLYQLENYCGK

SEQ ID NO: 25581 - protein, 31 aa, synthetic construct; identical to SEQ ID NO: 25394
  SITE 1: note ((2S,3S)-2,3-bis(1-hydroxy-1,3-dihydrobenzo[c][1,2]oxaborol e-6-carboxamido)butanoyl)-L-glutamic acid modified residue
  SITE 22: note ((2S,3S)-2,3-bis(1-hydroxy-1,3-dihydrobenzo[c][1,2]oxaborol e-6-carboxamido)butanoyl)-L-glutamic acid modified residue
  SITE 30: note ((2S,3S)-2,3-bis(1-hydroxy-1,3-dihydrobenzo[c][1,2]oxaborol e-6-carboxamido)butanoyl)-L-glutamic acid modified residue
  DISULFID 8: note = Interchain disulfide bond with the cysteine at position 7 of SEQ ID NO: 25580
  DISULFID 20: note = Interchain disulfide bond with the cysteine at position 20 of SEQ ID NO: 25580

SEQ ID NO: 25582 - protein, 22 aa, synthetic construct
  SITE 22: note ((2S,3S)-2,3-bis(1-hydroxy-1,3-dihydrobenzo[c][1,2]oxaborol e-6-carboxamido)butanoyl)-L-aspartic acid modified residue
  DISULFID 6..11: note = Intrachain disulfide bond
  DISULFID 7: note = Interchain disulfide bond with the cysteine at position 8 of SEQ ID NO: 25583
  DISULFID 20: note = Interchain disulfide bond with the cysteine at position 20 of SEQ ID NO: 25583
GIVEQCCTSICSLYQLENYCGK

SEQ ID NO: 25583 - protein, 31 aa, synthetic construct; identical to SEQ ID NO: 25394
  SITE 1: note ((2S,3S)-2,3-bis(1-hydroxy-1,3-dihydrobenzo[c][1,2]oxaborol e-6-carboxamido)butanoyl)-L-aspartic acid modified residue
  SITE 22: note ((2S,3S)-2,3-bis(1-hydroxy-1,3-dihydrobenzo[c][1,2]oxaborol e-6-carboxamido)butanoyl)-L-aspartic acid modified residue
  SITE 30: note ((2S,3S)-2,3-bis(1-hydroxy-1,3-dihydrobenzo[c][1,2]oxaborol e-6-carboxamido)butanoyl)-L-aspartic acid modified residue
  DISULFID 8: note = Interchain disulfide bond with the cysteine at position 7 of SEQ ID NO: 25582
  DISULFID 20: note = Interchain disulfide bond with the cysteine at position 20 of SEQ ID NO: 25582

SEQ ID NO: 25584 - protein, 22 aa, synthetic construct
  SITE 22: note ((2S,3S)-2,3-bis(4-fluoro-1-hydroxy-1,3-dihydrobenzo[c][1,2 ]oxaborole-6-carboxamido)butanoyl)-L-glutamic acid modified residue
  DISULFID 6..11: note = Intrachain disulfide bond
  DISULFID 7: note = Interchain disulfide bond with the cysteine at position 8 of SEQ ID NO: 25585
  DISULFID 20: note = Interchain disulfide bond with the cysteine at position 20 of SEQ ID NO: 25585
GIVEQCCTSICSLYQLENYCGK

SEQ ID NO: 25585 - protein, 31 aa, synthetic construct; identical to SEQ ID NO: 25394
  SITE 1: note ((2S,3S)-2,3-bis(4-fluoro-1-hydroxy-1,3-dihydrobenzo[c][1,2 ]oxaborole-6-carboxamido)butanoyl)-L-glutamic acid modified residue
  SITE 22: note ((2S,3S)-2,3-bis(4-fluoro-1-hydroxy-1,3-dihydrobenzo[c][1,2 ]oxaborole-6-carboxamido)butanoyl)-L-glutamic acid modified residue
  SITE 30: note ((2S,3S)-2,3-bis(4-fluoro-1-hydroxy-1,3-dihydrobenzo[c][1,2 ]oxaborole-6-carboxamido)butanoyl)-L-glutamic acid modified residue
  DISULFID 8: note = Interchain disulfide bond with the cysteine at position 7 of SEQ ID NO: 25584
  DISULFID 20: note = Interchain disulfide bond with the cysteine at position 20 of SEQ ID NO: 25584

SEQ ID NO: 25586 - protein, 22 aa, synthetic construct
  SITE 22: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  DISULFID 6..11: note = Intrachain disulfide bond
  DISULFID 7: note = Interchain disulfide bond with the cysteine at position 8 of SEQ ID NO: 25587
  DISULFID 20: note = Interchain disulfide bond with the cysteine at position 20 of SEQ ID NO: 25587
GIVEQCCTSICSLYQLENYCGK

SEQ ID NO: 25587 - protein, 31 aa, synthetic construct; identical to SEQ ID NO: 25394
  SITE 1: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  SITE 22: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  SITE 30: note ((2S,3S)-2-(1-hydroxy-4-(trifluoromethyl)-1,3-dihydrobenzo[ c][1,2]oxaborole-6-carboxamido)-3-(1-hydroxy-4-(trifluorome thyl)-2,3-dihydro-1H-benzo[b]borole-6-carboxamido)butanoyl) -L-aspartic acid modified residue
  DISULFID 8: note = Interchain disulfide bond with the cysteine at position 7 of SEQ ID NO: 25586
  DISULFID 20: note = Interchain disulfide bond with the cysteine at position 20 of SEQ ID NO: 25586

SEQ ID NO: 25588 - protein, 22 aa, synthetic construct
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  DISULFID 6..11: note = Intrachain disulfide bond
  DISULFID 7: note = Interchain disulfide bond with the cysteine at position 8 of SEQ ID NO: 25589
  DISULFID 20: note = Interchain disulfide bond with the cysteine at position 20 of SEQ ID NO: 25589
GIVEQCCTSICSLYQLENYCGK

SEQ ID NO: 25589 - protein, 31 aa, synthetic construct; identical to SEQ ID NO: 25394
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 22: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  SITE 30: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-glutamic acid modified residue
  DISULFID 8: note = Interchain disulfide bond with the cysteine at position 7 of SEQ ID NO: 25588
  DISULFID 20: note = Interchain disulfide bond with the cysteine at position 20 of SEQ ID NO: 25588

SEQ ID NO: 25590 - protein, 22 aa, synthetic construct
  SITE 22: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  DISULFID 6..11: note = Intrachain disulfide bond
  DISULFID 7: note = Interchain disulfide bond with the cysteine at position 8 of SEQ ID NO: 25591
  DISULFID 20: note = Interchain disulfide bond with the cysteine at position 20 of SEQ ID NO: 25591
GIVEQCCTSICSLYQLENYCGK

SEQ ID NO: 25591 - protein, 31 aa, synthetic construct; identical to SEQ ID NO: 25394
  SITE 1: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  SITE 22: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  SITE 30: note ((2S,4R)-1-(4-fluoro-1-hydroxy-1,3-dihydrobenzo[c][1,2]oxab orole-6-carbonyl)-4-(4-fluoro-1-hydroxy-1,3-dihydrobenzo[c] [1,2]oxaborole-6-carboxamido)pyrrolidine-2-carbonyl)-L-glut amic acid modified residue
  DISULFID 8: note = Interchain disulfide bond with the cysteine at position 7 of SEQ ID NO: 25590
  DISULFID 20: note = Interchain disulfide bond with the cysteine at position 20 of SEQ ID NO: 25590

SEQ ID NO: 25592 - protein, 21 aa, synthetic construct
  DISULFID 6..11: note = Intrachain disulfide bond
  DISULFID 7: note = Interchain disulfide bond with the cysteine at position 12 of SEQ ID NO: 25593
  DISULFID 20: note = Interchain disulfide bond with the cysteine at position 24 of SEQ ID NO: 25593
GIVEQCCTSICSLYQLENYCG

SEQ ID NO: 25593 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(pyridin-3-yl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(pyridin-3-yl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(pyridin-3-yl)propanoic acid modified residue
  DISULFID 12: note = Interchain disulfide bond with the cysteine at position 7 of SEQ ID NO: 25592
  DISULFID 24: note = Interchain disulfide bond with the cysteine at position 20 of SEQ ID NO: 25592

SEQ ID NO: 25594 - protein, 21 aa, synthetic construct
  DISULFID 6..11: note = Intrachain disulfide bond
  DISULFID 7: note = Interchain disulfide bond with the cysteine at position 12 of SEQ ID NO: 25595
  DISULFID 20: note = Interchain disulfide bond with the cysteine at position 24 of SEQ ID NO: 25595
GIVEQCCTSICSLYQLENYCG

SEQ ID NO: 25595 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(thiophen-2-yl)propanoi c acid modified residue
  SITE 5: note (S)-3-((2S,3S)-2,3-bis(1-hydroxy-1,3-dihydrobenzo[c][1,2]ox aborole-6-carboxamido)butanamido)-3-(thiophen-2-yl)propanoi c acid modified residue
  SITE 26: note (S)-3-((2S,3S)-2,3-bis(1-hydroxy-1,3-dihydrobenzo[c][1,2]ox aborole-6-carboxamido)butanamido)-3-(thiophen-2-yl)propanoi c acid modified residue
  DISULFID 12: note = Interchain disulfide bond with the cysteine at position 7 of SEQ ID NO: 25594
  DISULFID 24: note = Interchain disulfide bond with the cysteine at position 20 of SEQ ID NO: 25594

SEQ ID NO: 25596 - protein, 21 aa, synthetic construct
  DISULFID 6..11: note = Intrachain disulfide bond
  DISULFID 7: note = Interchain disulfide bond with the cysteine at position 12 of SEQ ID NO: 25597
  DISULFID 20: note = Interchain disulfide bond with the cysteine at position 24 of SEQ ID NO: 25597
GIVEQCCTSICSLYQLENYCG

SEQ ID NO: 25597 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(furan-2-yl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(furan-2-yl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(furan-2-yl)propanoic acid modified residue
  DISULFID 12: note = Interchain disulfide bond with the cysteine at position 7 of SEQ ID NO: 25596
  DISULFID 24: note = Interchain disulfide bond with the cysteine at position 20 of SEQ ID NO: 25596

SEQ ID NO: 25598 - protein, 21 aa, synthetic construct
  DISULFID 6..11: note = Intrachain disulfide bond
  DISULFID 7: note = Interchain disulfide bond with the cysteine at position 12 of SEQ ID NO: 25599
  DISULFID 20: note = Interchain disulfide bond with the cysteine at position 24 of SEQ ID NO: 25599
GIVEQCCTSICSLYQLENYCG

SEQ ID NO: 25599 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(thiophen-2-y l)butanoic acid modified residue
  DISULFID 12: note = Interchain disulfide bond with the cysteine at position 7 of SEQ ID NO: 25598
  DISULFID 24: note = Interchain disulfide bond with the cysteine at position 20 of SEQ ID NO: 25598

SEQ ID NO: 25600 - protein, 21 aa, synthetic construct
  DISULFID 6..11: note = Intrachain disulfide bond
  DISULFID 7: note = Interchain disulfide bond with the cysteine at position 12 of SEQ ID NO: 25601
  DISULFID 20: note = Interchain disulfide bond with the cysteine at position 24 of SEQ ID NO: 25601
GIVEQCCTSICSLYQLENYCG

SEQ ID NO: 25601 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  DISULFID 12: note = Interchain disulfide bond with the cysteine at position 7 of SEQ ID NO: 25600
  DISULFID 24: note = Interchain disulfide bond with the cysteine at position 20 of SEQ ID NO: 25600

SEQ ID NO: 25602 - protein, 21 aa, synthetic construct
  DISULFID 6..11: note = Intrachain disulfide bond
  DISULFID 7: note = Interchain disulfide bond with the cysteine at position 12 of SEQ ID NO: 25603
  DISULFID 20: note = Interchain disulfide bond with the cysteine at position 24 of SEQ ID NO: 25603
GIVEQCCTSICSLYQLENYCG

SEQ ID NO: 25603 - protein, 34 aa, synthetic construct; identical to SEQ ID NO: 25313
  SITE 1: note (S-3-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)-5-methylhexanoic acid modified residue
  SITE 5: note (S-3-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)-5-methylhexanoic acid modified residue
  SITE 26: note (S-3-((2S,4R)-1-(1-hydroxy-1,3-dihydrobenzo[c][1,2]oxaborol e-6-carbonyl)-4-(1-hydroxy-1,3-dihydrobenzo[c][1,2]oxaborol e-6-carboxamido)pyrrolidine-2-carboxamido)-5-methylhexanoic acid modified residue
  DISULFID 12: note = Interchain disulfide bond with the cysteine at position 7 of SEQ ID NO: 25602
  DISULFID 24: note = Interchain disulfide bond with the cysteine at position 20 of SEQ ID NO: 25602

SEQ ID NO: 25604 - protein, 21 aa, synthetic construct
  DISULFID 6..11: note = Intrachain disulfide bond
  DISULFID 7: note = Interchain disulfide bond with the cysteine at position 12 of SEQ ID NO: 25605
  DISULFID 20: note = Interchain disulfide bond with the cysteine at position 24 of SEQ ID NO: 25605
GIVEQCCTSICSLYQLENYCG

SEQ ID NO: 25605 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(pyridin-3-yl )propanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(pyridin-3-yl )propanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(pyridin-3-yl )propanoic acid modified residue
  DISULFID 12: note = Interchain disulfide bond with the cysteine at position 7 of SEQ ID NO: 25604
  DISULFID 24: note = Interchain disulfide bond with the cysteine at position 20 of SEQ ID NO: 25604

SEQ ID NO: 25606 - protein, 21 aa, synthetic construct
  DISULFID 6..11: note = Intrachain disulfide bond
  DISULFID 7: note = Interchain disulfide bond with the cysteine at position 12 of SEQ ID NO: 25607
  DISULFID 20: note = Interchain disulfide bond with the cysteine at position 24 of SEQ ID NO: 25607
GIVEQCCTSICSLYQLENYCG

SEQ ID NO: 25607 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(3,5-dimethoxyphenyl)pr opanoic acid modified residue
  SITE 5: note (S)-3-((2S,3S)-2,3-bis(1-hydroxy-1,3-dihydrobenzo[c][1,2]ox aborole-6-carboxamido)butanamido)-3-(3,5-dimethoxyphenyl)pr opanoic acid modified residue
  SITE 26: note (S)-3-((2S,3S)-2,3-bis(1-hydroxy-1,3-dihydrobenzo[c][1,2]ox aborole-6-carboxamido)butanamido)-3-(3,5-dimethoxyphenyl)pr opanoic acid modified residue
  DISULFID 12: note = Interchain disulfide bond with the cysteine at position 7 of SEQ ID NO: 25606
  DISULFID 24: note = Interchain disulfide bond with the cysteine at position 20 of SEQ ID NO: 25606

SEQ ID NO: 25608 - protein, 21 aa, synthetic construct
  DISULFID 6..11: note = Intrachain disulfide bond
  DISULFID 7: note = Interchain disulfide bond with the cysteine at position 12 of SEQ ID NO: 25609
  DISULFID 20: note = Interchain disulfide bond with the cysteine at position 24 of SEQ ID NO: 25609
GIVEQCCTSICSLYQLENYCG

SEQ ID NO: 25609 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  DISULFID 12: note = Interchain disulfide bond with the cysteine at position 7 of SEQ ID NO: 25608
  DISULFID 24: note = Interchain disulfide bond with the cysteine at position 20 of SEQ ID NO: 25608

SEQ ID NO: 25610 - protein, 21 aa, synthetic construct
  DISULFID 6..11: note = Intrachain disulfide bond
  DISULFID 7: note = Interchain disulfide bond with the cysteine at position 12 of SEQ ID NO: 25611
  DISULFID 20: note = Interchain disulfide bond with the cysteine at position 24 of SEQ ID NO: 25611
GIVEQCCTSICSLYQLENYCG

SEQ ID NO: 25611 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-5-methylhexanoic acid modified residue
  SITE 5: note (S)-3-((2S,3S)-2,3-bis(1-hydroxy-1,3-dihydrobenzo[c][1,2]ox aborole-6-carboxamido)butanamido)-5-methylhexanoic acid modified residue
  SITE 26: note (S)-3-((2S,3S)-2,3-bis(1-hydroxy-1,3-dihydrobenzo[c][1,2]ox aborole-6-carboxamido)butanamido)-5-methylhexanoic acid modified residue
  DISULFID 12: note = Interchain disulfide bond with the cysteine at position 7 of SEQ ID NO: 25610
  DISULFID 24: note = Interchain disulfide bond with the cysteine at position 20 of SEQ ID NO: 25610

SEQ ID NO: 25612 - protein, 21 aa, synthetic construct
  DISULFID 6..11: note = Intrachain disulfide bond
  DISULFID 7: note = Interchain disulfide bond with the cysteine at position 12 of SEQ ID NO: 25613
  DISULFID 20: note = Interchain disulfide bond with the cysteine at position 24 of SEQ ID NO: 25613
GIVEQCCTSICSLYQLENYCG

SEQ ID NO: 25613 - protein, 34 aa, synthetic construct; identical to SEQ ID NO: 25310
  SITE 1: note 2-((R)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)-1,2,3,4-tetrahy droisoquinolin-3-yl)acetic acid modified residue
  SITE 5: note 2-((R)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)-1,2,3,4-tetrahy droisoquinolin-3-yl)acetic acid modified residue
  SITE 26: note 2-((R)-2-((2S,4R)-1-(1-hydroxy-1,3-dihydrobenzo[c][1,2]oxab orole-6-carbonyl)-4-(1-hydroxy-1,3-dihydrobenzo[c][1,2]oxab orole-6-carboxamido)pyrrolidine-2-carbonyl)-1,2,3,4-tetrahy droisoquinolin-3-yl)acetic acid modified residue
  DISULFID 12: note = Interchain disulfide bond with the cysteine at position 7 of SEQ ID NO: 25612
  DISULFID 24: note = Interchain disulfide bond with the cysteine at position 20 of SEQ ID NO: 25612

SEQ ID NO: 25614 - protein, 21 aa, synthetic construct
  DISULFID 6..11: note = Intrachain disulfide bond
  DISULFID 7: note = Interchain disulfide bond with the cysteine at position 12 of SEQ ID NO: 25615
  DISULFID 20: note = Interchain disulfide bond with the cysteine at position 24 of SEQ ID NO: 25615
GIVEQCCTSICSLYQLENYCG

SEQ ID NO: 25615 - protein, 34 aa, synthetic construct; identical to SEQ ID NO: 25310
  SITE 1: note (S)-3-(3,5-dimethoxyphenyl)-3-((2S,4R)-1-(1-hydroxy-1,3-dih ydrobenzo[c][1,2]oxaborole-6-carbonyl)-4-(1-hydroxy-1,3-dih ydrobenzo[c][1,2]oxaborole-6-carboxamido)pyrrolidine-2-carb oxamido)propanoic acid modified residue
  SITE 5: note (S)-3-(3,5-dimethoxyphenyl)-3-((2S,4R)-1-(1-hydroxy-1,3-dih ydrobenzo[c][1,2]oxaborole-6-carbonyl)-4-(1-hydroxy-1,3-dih ydrobenzo[c][1,2]oxaborole-6-carboxamido)pyrrolidine-2-carb oxamido)propanoic acid modified residue
  SITE 26: note (S)-3-(3,5-dimethoxyphenyl)-3-((2S,4R)-1-(1-hydroxy-1,3-dih ydrobenzo[c][1,2]oxaborole-6-carbonyl)-4-(1-hydroxy-1,3-dih ydrobenzo[c][1,2]oxaborole-6-carboxamido)pyrrolidine-2-carb oxamido)propanoic acid modified residue
  DISULFID 12: note = Interchain disulfide bond with the cysteine at position 7 of SEQ ID NO: 25614
  DISULFID 24: note = Interchain disulfide bond with the cysteine at position 20 of SEQ ID NO: 25614

SEQ ID NO: 25616 - protein, 21 aa, synthetic construct
  DISULFID 6..11: note = Intrachain disulfide bond
  DISULFID 7: note = Interchain disulfide bond with the cysteine at position 12 of SEQ ID NO: 25617
  DISULFID 20: note = Interchain disulfide bond with the cysteine at position 24 of SEQ ID NO: 25617
GIVEQCCTSICSLYQLENYCN

SEQ ID NO: 25617 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(p-tolyl)propanoic acid modified residue
  DISULFID 12: note = Interchain disulfide bond with the cysteine at position 7 of SEQ ID NO: 25616
  DISULFID 24: note = Interchain disulfide bond with the cysteine at position 20 of SEQ ID NO: 25616

SEQ ID NO: 25618 - protein, 21 aa, synthetic construct
  DISULFID 6..11: note = Intrachain disulfide bond
  DISULFID 7: note = Interchain disulfide bond with the cysteine at position 12 of SEQ ID NO: 25619
  DISULFID 20: note = Interchain disulfide bond with the cysteine at position 24 of SEQ ID NO: 25619
GIVEQCCTSICSLYQLENYCG

SEQ ID NO: 25619 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(4-fluorophenyl)propano ic acid modified residue
  SITE 5: note (S)-3-((2S,3S)-2,3-bis(1-hydroxy-1,3-dihydrobenzo[c][1,2]ox aborole-6-carboxamido)butanamido)-3-(4-fluorophenyl)propano ic acid modified residue
  SITE 26: note (S)-3-((2S,3S)-2,3-bis(1-hydroxy-1,3-dihydrobenzo[c][1,2]ox aborole-6-carboxamido)butanamido)-3-(4-fluorophenyl)propano ic acid modified residue
  DISULFID 12: note = Interchain disulfide bond with the cysteine at position 7 of SEQ ID NO: 25618
  DISULFID 24: note = Interchain disulfide bond with the cysteine at position 20 of SEQ ID NO: 25618

SEQ ID NO: 25620 - protein, 21 aa, synthetic construct
  DISULFID 6..11: note = Intrachain disulfide bond
  DISULFID 7: note = Interchain disulfide bond with the cysteine at position 12 of SEQ ID NO: 25621
  DISULFID 20: note = Interchain disulfide bond with the cysteine at position 24 of SEQ ID NO: 25621
GIVEQCCTSICSLYQLENYCG

SEQ ID NO: 25621 - protein, 34 aa, synthetic construct; identical to SEQ ID NO: 25310
  SITE 1: note 2-((S)-2-((2S,3S)-2,3-bis(1-hydroxy-1,3-dihydrobenzo[c][1,2 ]oxaborole-6-carboxamido)butanoyl)-1,2,3,4-tetrahydroisoqui nolin-3-yl)acetic acid modified residue
  SITE 5: note 2-((S)-2-((2S,3S)-2,3-bis(1-hydroxy-1,3-dihydrobenzo[c][1,2 ]oxaborole-6-carboxamido)butanoyl)-1,2,3,4-tetrahydroisoqui nolin-3-yl)acetic acid modified residue
  SITE 26: note 2-((S)-2-((2S,3S)-2,3-bis(1-hydroxy-1,3-dihydrobenzo[c][1,2 ]oxaborole-6-carboxamido)butanoyl)-1,2,3,4-tetrahydroisoqui nolin-3-yl)acetic acid modified residue
  DISULFID 12: note = Interchain disulfide bond with the cysteine at position 7 of SEQ ID NO: 25620
  DISULFID 24: note = Interchain disulfide bond with the cysteine at position 20 of SEQ ID NO: 25620

SEQ ID NO: 25622 - protein, 21 aa, synthetic construct
  DISULFID 6..11: note = Intrachain disulfide bond
  DISULFID 7: note = Interchain disulfide bond with the cysteine at position 12 of SEQ ID NO: 25623
  DISULFID 20: note = Interchain disulfide bond with the cysteine at position 24 of SEQ ID NO: 25623
GIVEQCCTSICSLYQLENYCG

SEQ ID NO: 25623 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(2-methoxyphe nyl)propanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(2-methoxyphe nyl)propanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(2-methoxyphe nyl)propanoic acid modified residue
  DISULFID 12: note = Interchain disulfide bond with the cysteine at position 7 of SEQ ID NO: 25622
  DISULFID 24: note = Interchain disulfide bond with the cysteine at position 20 of SEQ ID NO: 25622

SEQ ID NO: 25624 - protein, 21 aa, synthetic construct
  DISULFID 6..11: note = Intrachain disulfide bond
  DISULFID 7: note = Interchain disulfide bond with the cysteine at position 12 of SEQ ID NO: 25625
  DISULFID 20: note = Interchain disulfide bond with the cysteine at position 24 of SEQ ID NO: 25625
GIVEQCCTSICSLYQLENYCN

SEQ ID NO: 25625 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(p-tolyl)prop anoic acid modified residue
  DISULFID 12: note = Interchain disulfide bond with the cysteine at position 7 of SEQ ID NO: 25624
  DISULFID 24: note = Interchain disulfide bond with the cysteine at position 20 of SEQ ID NO: 25624

SEQ ID NO: 25626 - protein, 21 aa, synthetic construct
  DISULFID 6..11: note = Intrachain disulfide bond
  DISULFID 7: note = Interchain disulfide bond with the cysteine at position 12 of SEQ ID NO: 25627
  DISULFID 20: note = Interchain disulfide bond with the cysteine at position 24 of SEQ ID NO: 25627
GIVEQCCTSICSLYQLENYCG

SEQ ID NO: 25627 - protein, 34 aa, synthetic construct; identical to SEQ ID NO: 25310
  SITE 1: note (S)-3-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  SITE 5: note (S)-3-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  SITE 26: note (S)-3-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  DISULFID 12: note = Interchain disulfide bond with the cysteine at position 7 of SEQ ID NO: 25626
  DISULFID 24: note = Interchain disulfide bond with the cysteine at position 20 of SEQ ID NO: 25626

SEQ ID NO: 25628 - protein, 21 aa, synthetic construct
  DISULFID 6..11: note = Intrachain disulfide bond
  DISULFID 7: note = Interchain disulfide bond with the cysteine at position 12 of SEQ ID NO: 25629
  DISULFID 20: note = Interchain disulfide bond with the cysteine at position 24 of SEQ ID NO: 25629
GIVEQCCTSICSLYQLENYCG

SEQ ID NO: 25629 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(3-(trifluoromethyl)phe nyl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(3-(trifluoromethyl)phe nyl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(3-(trifluoromethyl)phe nyl)propanoic acid modified residue
  DISULFID 12: note = Interchain disulfide bond with the cysteine at position 7 of SEQ ID NO: 25628
  DISULFID 24: note = Interchain disulfide bond with the cysteine at position 20 of SEQ ID NO: 25628

SEQ ID NO: 25630 - protein, 21 aa, synthetic construct
  DISULFID 6..11: note = Intrachain disulfide bond
  DISULFID 7: note = Interchain disulfide bond with the cysteine at position 12 of SEQ ID NO: 25631
  DISULFID 20: note = Interchain disulfide bond with the cysteine at position 24 of SEQ ID NO: 25631
GIVEQCCTSICSLYQLENYCG

SEQ ID NO: 25631 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(2-methoxyphenyl)propan oic acid modified residue
  SITE 5: note (S)-3-((2S,3S)-2,3-bis(1-hydroxy-1,3-dihydrobenzo[c][1,2]ox aborole-6-carboxamido)butanamido)-3-(2-methoxyphenyl)propan oic acid modified residue
  SITE 26: note (S)-3-((2S,3S)-2,3-bis(1-hydroxy-1,3-dihydrobenzo[c][1,2]ox aborole-6-carboxamido)butanamido)-3-(2-methoxyphenyl)propan oic acid modified residue
  DISULFID 12: note = Interchain disulfide bond with the cysteine at position 7 of SEQ ID NO: 25630
  DISULFID 24: note = Interchain disulfide bond with the cysteine at position 20 of SEQ ID NO: 25630

SEQ ID NO: 25632 - protein, 21 aa, synthetic construct
  DISULFID 6..11: note = Intrachain disulfide bond
  DISULFID 7: note = Interchain disulfide bond with the cysteine at position 12 of SEQ ID NO: 25633
  DISULFID 20: note = Interchain disulfide bond with the cysteine at position 24 of SEQ ID NO: 25633
GIVEQCCTSICSLYQLENYCG

SEQ ID NO: 25633 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(3-(trifluoro methyl)phenyl)propanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(3-(trifluoro methyl)phenyl)propanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(3-(trifluoro methyl)phenyl)propanoic acid modified residue
  DISULFID 12: note = Interchain disulfide bond with the cysteine at position 7 of SEQ ID NO: 25632
  DISULFID 24: note = Interchain disulfide bond with the cysteine at position 20 of SEQ ID NO: 25632

SEQ ID NO: 25634 - protein, 21 aa, synthetic construct
  DISULFID 6..11: note = Intrachain disulfide bond
  DISULFID 7: note = Interchain disulfide bond with the cysteine at position 12 of SEQ ID NO: 25635
  DISULFID 20: note = Interchain disulfide bond with the cysteine at position 24 of SEQ ID NO: 25635
GIVEQCCTSICSLYQLENYCG

SEQ ID NO: 25635 - protein, 34 aa, synthetic construct; identical to SEQ ID NO: 25310
  SITE 1: note (S)-3-(furan-2-yl)-3-((2S,4R)-1-(1-hydroxy-1,3-dihydrobenzo [c][1,2]oxaborole-6-carbonyl)-4-(1-hydroxy-1,3-dihydrobenzo [c][1,2]oxaborole-6-carboxamido)pyrrolidine-2-carboxamido)p ropanoic acid modified residue
  SITE 5: note (S)-3-(furan-2-yl)-3-((2S,4R)-1-(1-hydroxy-1,3-dihydrobenzo [c][1,2]oxaborole-6-carbonyl)-4-(1-hydroxy-1,3-dihydrobenzo [c][1,2]oxaborole-6-carboxamido)pyrrolidine-2-carboxamido)p ropanoic acid modified residue
  SITE 26: note (S)-3-(furan-2-yl)-3-((2S,4R)-1-(1-hydroxy-1,3-dihydrobenzo [c][1,2]oxaborole-6-carbonyl)-4-(1-hydroxy-1,3-dihydrobenzo [c][1,2]oxaborole-6-carboxamido)pyrrolidine-2-carboxamido)p ropanoic acid modified residue
  DISULFID 12: note = Interchain disulfide bond with the cysteine at position 7 of SEQ ID NO: 25634
  DISULFID 24: note = Interchain disulfide bond with the cysteine at position 20 of SEQ ID NO: 25634

SEQ ID NO: 25636 - protein, 21 aa, synthetic construct
  DISULFID 6..11: note = Intrachain disulfide bond
  DISULFID 7: note = Interchain disulfide bond with the cysteine at position 12 of SEQ ID NO: 25637
  DISULFID 20: note = Interchain disulfide bond with the cysteine at position 24 of SEQ ID NO: 25637
GIVEQCCTSICSLYQLENYCG

SEQ ID NO: 25637 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(m-tolyl)propanoic acid modified residue
  SITE 5: note (S)-3-((2S,3S)-2,3-bis(1-hydroxy-1,3-dihydrobenzo[c][1,2]ox aborole-6-carboxamido)butanamido)-3-(m-tolyl)propanoic acid modified residue
  SITE 26: note (S)-3-((2S,3S)-2,3-bis(1-hydroxy-1,3-dihydrobenzo[c][1,2]ox aborole-6-carboxamido)butanamido)-3-(m-tolyl)propanoic acid modified residue
  DISULFID 12: note = Interchain disulfide bond with the cysteine at position 7 of SEQ ID NO: 25636
  DISULFID 24: note = Interchain disulfide bond with the cysteine at position 20 of SEQ ID NO: 25636

SEQ ID NO: 25638 - protein, 21 aa, synthetic construct
  DISULFID 6..11: note = Intrachain disulfide bond
  DISULFID 7: note = Interchain disulfide bond with the cysteine at position 12 of SEQ ID NO: 25639
  DISULFID 20: note = Interchain disulfide bond with the cysteine at position 24 of SEQ ID NO: 25639
GIVEQCCTSICSLYQLENYCG

SEQ ID NO: 25639 - protein, 34 aa, synthetic construct; identical to SEQ ID NO: 25310
  SITE 1: note (S)-3-((2S,3S)-2,3-bis(1-hydroxy-1,3-dihydrobenzo[c][1,2]ox aborole-6-carboxamido)butanamido)-3-(3-fluorophenyl)propano ic acid modified residue
  SITE 5: note (S)-3-((2S,3S)-2,3-bis(1-hydroxy-1,3-dihydrobenzo[c][1,2]ox aborole-6-carboxamido)butanamido)-3-(3-fluorophenyl)propano ic acid modified residue
  SITE 26: note (S)-3-((2S,3S)-2,3-bis(1-hydroxy-1,3-dihydrobenzo[c][1,2]ox aborole-6-carboxamido)butanamido)-3-(3-fluorophenyl)propano ic acid modified residue
  DISULFID 12: note = Interchain disulfide bond with the cysteine at position 7 of SEQ ID NO: 25638
  DISULFID 24: note = Interchain disulfide bond with the cysteine at position 20 of SEQ ID NO: 25638

SEQ ID NO: 25640 - protein, 21 aa, synthetic construct
  DISULFID 6..11: note = Intrachain disulfide bond
  DISULFID 7: note = Interchain disulfide bond with the cysteine at position 12 of SEQ ID NO: 25641
  DISULFID 20: note = Interchain disulfide bond with the cysteine at position 24 of SEQ ID NO: 25641
GIVEQCCTSICSLYQLENYCG

SEQ ID NO: 25641 - protein, 34 aa, synthetic construct; identical to SEQ ID NO: 25310
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(m-tolyl)prop anoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(m-tolyl)prop anoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-(m-tolyl)prop anoic acid modified residue
  DISULFID 12: note = Interchain disulfide bond with the cysteine at position 7 of SEQ ID NO: 25640
  DISULFID 24: note = Interchain disulfide bond with the cysteine at position 20 of SEQ ID NO: 25640

SEQ ID NO: 25642 - protein, 21 aa, synthetic construct
  DISULFID 6..11: note = Intrachain disulfide bond
  DISULFID 7: note = Interchain disulfide bond with the cysteine at position 12 of SEQ ID NO: 25643
  DISULFID 20: note = Interchain disulfide bond with the cysteine at position 24 of SEQ ID NO: 25643
GIVEQCCTSICSLYQLENYCG

SEQ ID NO: 25643 - protein, 34 aa, synthetic construct; identical to SEQ ID NO: 25310
  SITE 1: note (S)-3-(3-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  SITE 5: note (S)-3-(3-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  SITE 26: note (S)-3-(3-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)propanoic acid modified residue
  DISULFID 12: note = Interchain disulfide bond with the cysteine at position 7 of SEQ ID NO: 25642
  DISULFID 24: note = Interchain disulfide bond with the cysteine at position 20 of SEQ ID NO: 25642

SEQ ID NO: 25644 - protein, 21 aa, synthetic construct
  DISULFID 6..11: note = Intrachain disulfide bond
  DISULFID 7: note = Interchain disulfide bond with the cysteine at position 12 of SEQ ID NO: 25645
  DISULFID 20: note = Interchain disulfide bond with the cysteine at position 24 of SEQ ID NO: 25645
GIVEQCCTSICSLYQLENYCG

SEQ ID NO: 25645 - protein, 34 aa, synthetic construct; identical to SEQ ID NO: 25307
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 5: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 26: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 12: note = Interchain disulfide bond with the cysteine at position 7 of SEQ ID NO: 25644
  DISULFID 24: note = Interchain disulfide bond with the cysteine at position 20 of SEQ ID NO: 25644

SEQ ID NO: 25646 - protein, 21 aa, synthetic construct
  DISULFID 6..11: note = Intrachain disulfide bond
  DISULFID 7: note = Interchain disulfide bond with the cysteine at position 12 of SEQ ID NO: 25647
  DISULFID 20: note = Interchain disulfide bond with the cysteine at position 24 of SEQ ID NO: 25647
GIVEQCCTSICSLYQLENYCG

SEQ ID NO: 25647 - protein, 34 aa, synthetic construct; identical to SEQ ID NO: 25307
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25646
  DISULFID 24: note = Interchain disulfide bond with the cysteine at position 20 of SEQ ID NO: 25646

SEQ ID NO: 25648 - protein, 21 aa, synthetic construct
  DISULFID 6..11: note = Intrachain disulfide bond
  DISULFID 7: note = Interchain disulfide bond with the cysteine at position 12 of SEQ ID NO: 25649
  DISULFID 20: note = Interchain disulfide bond with the cysteine at position 24 of SEQ ID NO: 25649
GIVEQCCTSICSLYQLENYCG

SEQ ID NO: 25649 - protein, 34 aa, synthetic construct; identical to SEQ ID NO: 25308
  SITE 1: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 5: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  SITE 26: note ((2S,4R)-1-(1-hydroxy-1,3-dihydrobenzo[c][1,2]oxaborole-6-c arbonyl)-4-(1-hydroxy-1,3-dihydrobenzo[c][1,2]oxaborole-6-c arboxamido)pyrrolidine-2-carbonyl)-L-aspartic acid modified residue
  DISULFID 12: note = Interchain disulfide bond with the cysteine at position 7 of SEQ ID NO: 25648
  DISULFID 24: note = Interchain disulfide bond with the cysteine at position 20 of SEQ ID NO: 25648

SEQ ID NO: 25650 - protein, 21 aa, synthetic construct
  DISULFID 6..11: note = Intrachain disulfide bond
  DISULFID 7: note = Interchain disulfide bond with the cysteine at position 12 of SEQ ID NO: 25651
  DISULFID 20: note = Interchain disulfide bond with the cysteine at position 24 of SEQ ID NO: 25651
GIVEQCCTSICSLYQLENYCG

SEQ ID NO: 25651 - protein, 34 aa, synthetic construct; identical to SEQ ID NO: 25308
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 5: note 3-((2S,3S)-2,3-bis(1-hydroxy-1,3-dihydrobenzo[c][1,2]oxabor ole-6-carboxamido)butanamido)propanoic acid modified residue
  SITE 26: note 3-((2S,3S)-2,3-bis(1-hydroxy-1,3-dihydrobenzo[c][1,2]oxabor ole-6-carboxamido)butanamido)propanoic acid modified residue
  DISULFID 12: note = Interchain disulfide bond with the cysteine at position 7 of SEQ ID NO: 25650
  DISULFID 24: note = Interchain disulfide bond with the cysteine at position 20 of SEQ ID NO: 25650

SEQ ID NO: 25652 - protein, 21 aa, synthetic construct
  DISULFID 6..11: note = Intrachain disulfide bond
  DISULFID 7: note = Interchain disulfide bond with the cysteine at position 24 of SEQ ID NO: 25653
  DISULFID 20: note = Interchain disulfide bond with the cysteine at position 36 of SEQ ID NO: 25653
GIVEQCCTSICSLYQLENYCN

SEQ ID NO: 25653 - protein, 46 aa, synthetic construct; identical to SEQ ID NO: 25397
  SITE 2: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 46: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 24: note = Interchain disulfide bond with the cysteine at position 7 of SEQ ID NO: 25652
  DISULFID 36: note = Interchain disulfide bond with the cysteine at position 20 of SEQ ID NO: 25652

SEQ ID NO: 25654 - protein, 21 aa, synthetic construct
  DISULFID 6..11: note = Intrachain disulfide bond
  DISULFID 7: note = Interchain disulfide bond with the cysteine at position 24 of SEQ ID NO: 25655
  DISULFID 20: note = Interchain disulfide bond with the cysteine at position 36 of SEQ ID NO: 25655
GIVEQCCTSICSLYQLENYCN

SEQ ID NO: 25655 - protein, 46 aa, synthetic construct; identical to SEQ ID NO: 25397
  SITE 2: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 46: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 24: note = Interchain disulfide bond with the cysteine at position 7 of SEQ ID NO: 25654
  DISULFID 36: note = Interchain disulfide bond with the cysteine at position 20 of SEQ ID NO: 25654

SEQ ID NO: 25656 - protein, 21 aa, synthetic construct
  DISULFID 6..11: note = Intrachain disulfide bond
  DISULFID 7: note = Interchain disulfide bond with the cysteine at position 23 of SEQ ID NO: 25657
  DISULFID 20: note = Interchain disulfide bond with the cysteine at position 35 of SEQ ID NO: 25657
GIVEQCCTSICSLYQLENYCG

SEQ ID NO: 25657 - protein, 45 aa, synthetic construct; identical to SEQ ID NO: 25382
  SITE 1: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 45: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 23: note = Interchain disulfide bond with the cysteine at position 7 of SEQ ID NO: 25656
  DISULFID 35: note = Interchain disulfide bond with the cysteine at position 20 of SEQ ID NO: 25656

SEQ ID NO: 25658 - protein, 21 aa, synthetic construct
  DISULFID 6..11: note = Intrachain disulfide bond
  DISULFID 7: note = Interchain disulfide bond with the cysteine at position 23 of SEQ ID NO: 25659
  DISULFID 20: note = Interchain disulfide bond with the cysteine at position 35 of SEQ ID NO: 25659
GIVEQCCTSICSLYQLENYCG

SEQ ID NO: 25659 - protein, 45 aa, synthetic construct; identical to SEQ ID NO: 25382
  SITE 1: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 45: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 23: note = Interchain disulfide bond with the cysteine at position 7 of SEQ ID NO: 25658
  DISULFID 35: note = Interchain disulfide bond with the cysteine at position 20 of SEQ ID NO: 25658

SEQ ID NO: 25660 - protein, 21 aa, synthetic construct
  DISULFID 6..11: note = Intrachain disulfide bond
  DISULFID 7: note = Interchain disulfide bond with the cysteine at position 23 of SEQ ID NO: 25661
  DISULFID 20: note = Interchain disulfide bond with the cysteine at position 35 of SEQ ID NO: 25661
GIVEQCCTSICSLYQLENYCG

SEQ ID NO: 25661 - protein, 45 aa, synthetic construct; identical to SEQ ID NO: 25382
  SITE 1: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  SITE 45: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-glutamic acid modified residue
  DISULFID 23: note = Interchain disulfide bond with the cysteine at position 7 of SEQ ID NO: 25660
  DISULFID 35: note = Interchain disulfide bond with the cysteine at position 20 of SEQ ID NO: 25660

SEQ ID NO: 25662 - protein, 21 aa, synthetic construct
  DISULFID 6..11: note = Intrachain disulfide bond
  DISULFID 7: note = Interchain disulfide bond with the cysteine at position 23 of SEQ ID NO: 25663
  DISULFID 20: note = Interchain disulfide bond with the cysteine at position 35 of SEQ ID NO: 25663
GIVEQCCTSICSLYQLENYCG

SEQ ID NO: 25663 - protein, 45 aa, synthetic construct; identical to SEQ ID NO: 25382
  SITE 1: note ((2S,4R)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  SITE 45: note ((2S,4R)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  DISULFID 23: note = Interchain disulfide bond with the cysteine at position 7 of SEQ ID NO: 25662
  DISULFID 35: note = Interchain disulfide bond with the cysteine at position 20 of SEQ ID NO: 25662

SEQ ID NO: 25664 - protein, 21 aa, synthetic construct
  DISULFID 6..11: note = Intrachain disulfide bond
  DISULFID 7: note = Interchain disulfide bond with the cysteine at position 12 of SEQ ID NO: 25665
  DISULFID 20: note = Interchain disulfide bond with the cysteine at position 24 of SEQ ID NO: 25665
GIVEQCCTSICSLYQLENYCG

SEQ ID NO: 25665 - protein, 34 aa, synthetic construct; identical to SEQ ID NO: 25313
  SITE 1: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 5: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 26: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  DISULFID 12: note = Interchain disulfide bond with the cysteine at position 7 of SEQ ID NO: 25664
  DISULFID 24: note = Interchain disulfide bond with the cysteine at position 20 of SEQ ID NO: 25664

SEQ ID NO: 25666 - protein, 21 aa, synthetic construct
  DISULFID 6..11: note = Intrachain disulfide bond
  DISULFID 7: note = Interchain disulfide bond with the cysteine at position 12 of SEQ ID NO: 25667
  DISULFID 20: note = Interchain disulfide bond with the cysteine at position 24 of SEQ ID NO: 25667
GIVEQCCTSICSLYQLENYCN

SEQ ID NO: 25667 - protein, 34 aa, synthetic construct; identical to SEQ ID NO: 25313
  SITE 1: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 5: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 26: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  DISULFID 12: note = Interchain disulfide bond with the cysteine at position 7 of SEQ ID NO: 25666
  DISULFID 24: note = Interchain disulfide bond with the cysteine at position 20 of SEQ ID NO: 25666

SEQ ID NO: 25668 - protein, 21 aa, synthetic construct
  DISULFID 6..11: note = Intrachain disulfide bond
  DISULFID 7: note = Interchain disulfide bond with the cysteine at position 12 of SEQ ID NO: 25669
  DISULFID 20: note = Interchain disulfide bond with the cysteine at position 24 of SEQ ID NO: 25669
GIVEQCCTSICSLYQLENYCG

SEQ ID NO: 25669 - protein, 34 aa, synthetic construct; identical to SEQ ID NO: 25312
  SITE 1: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 5: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 26: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  DISULFID 12: note = Interchain disulfide bond with the cysteine at position 7 of SEQ ID NO: 25668
  DISULFID 24: note = Interchain disulfide bond with the cysteine at position 20 of SEQ ID NO: 25668

SEQ ID NO: 25670 - protein, 21 aa, synthetic construct
  DISULFID 6..11: note = Intrachain disulfide bond
  DISULFID 7: note = Interchain disulfide bond with the cysteine at position 12 of SEQ ID NO: 25671
  DISULFID 20: note = Interchain disulfide bond with the cysteine at position 24 of SEQ ID NO: 25671
GIVEQCCTSICSLYQLENYCG

SEQ ID NO: 25671 - protein, 34 aa, synthetic construct; identical to SEQ ID NO: 25308
  SITE 1: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 5: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  SITE 26: note (S)-4-(4-fluorophenyl)-3-((2S,4R)-1-(1-hydroxy-1,3-dihydrob enzo[c][1,2]oxaborole-6-carbonyl)-4-(1-hydroxy-1,3-dihydrob enzo[c][1,2]oxaborole-6-carboxamido)pyrrolidine-2-carboxami do)butanoic acid modified residue
  DISULFID 12: note = Interchain disulfide bond with the cysteine at position 7 of SEQ ID NO: 25670
  DISULFID 24: note = Interchain disulfide bond with the cysteine at position 20 of SEQ ID NO: 25670

SEQ ID NO: 25672 - protein, 22 aa, synthetic construct
  SITE 22: note 3-((2S,3S)-2,3-bis(4-fluoro-1-hydroxy-1,3-dihydrobenzo[c][1 ,2]oxaborole-6-carboxamido)butanamido)propanoic acid modified residue
  DISULFID 6..11: note = Intrachain disulfide bond
  DISULFID 7: note = Interchain disulfide bond with the cysteine at position 12 of SEQ ID NO: 25673
  DISULFID 20: note = Interchain disulfide bond with the cysteine at position 24 of SEQ ID NO: 25673
GIVEQCCTSICSLYQLENYCGK

SEQ ID NO: 25673 - protein, 34 aa, synthetic construct; identical to SEQ ID NO: 25313
  SITE 1: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 5: note 3-((2S,3S)-2,3-bis(4-fluoro-1-hydroxy-1,3-dihydrobenzo[c][1 ,2]oxaborole-6-carboxamido)butanamido)propanoic acid modified residue
  SITE 26: note 3-((2S,3S)-2,3-bis(4-fluoro-1-hydroxy-1,3-dihydrobenzo[c][1 ,2]oxaborole-6-carboxamido)butanamido)propanoic acid modified residue
  DISULFID 12: note = Interchain disulfide bond with the cysteine at position 7 of SEQ ID NO: 25672
  DISULFID 24: note = Interchain disulfide bond with the cysteine at position 20 of SEQ ID NO: 25672

SEQ ID NO: 25674 - protein, 22 aa, synthetic construct
  SITE 22: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  DISULFID 6..11: note = Intrachain disulfide bond
  DISULFID 7: note = Interchain disulfide bond with the cysteine at position 12 of SEQ ID NO: 25675
  DISULFID 20: note = Interchain disulfide bond with the cysteine at position 24 of SEQ ID NO: 25675
GIVEQCCTSICSLYQLENYCGK

SEQ ID NO: 25675 - protein, 34 aa, synthetic construct; identical to SEQ ID NO: 25313
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  DISULFID 12: note = Interchain disulfide bond with the cysteine at position 7 of SEQ ID NO: 25674
  DISULFID 24: note = Interchain disulfide bond with the cysteine at position 20 of SEQ ID NO: 25674

SEQ ID NO: 25676 - protein, 22 aa, synthetic construct
  SITE 22: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]3-((2S, 4R)-1-(1-hydroxy-1,3-dihydrobenzo[c][1,2]oxaborole-6-carbon yl)-4-(1-hydroxy-1,3-dihydrobenzo[c][1,2]oxaborole-6-carbox amido)pyrrolidine-2-carboxamido)propanoic acid modified residue
  DISULFID 6..11: note = Intrachain disulfide bond
  DISULFID 7: note = Interchain disulfide bond with the cysteine at position 12 of SEQ ID NO: 25677
  DISULFID 20: note = Interchain disulfide bond with the cysteine at position 24 of SEQ ID NO: 25677
GIVEQCCTSICSLYQLENYCGK

SEQ ID NO: 25677 - protein, 34 aa, synthetic construct; identical to SEQ ID NO: 25313
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]3-((2S, 4R)-1-(1-hydroxy-1,3-dihydrobenzo[c][1,2]oxaborole-6-carbon yl)-4-(1-hydroxy-1,3-dihydrobenzo[c][1,2]oxaborole-6-carbox amido)pyrrolidine-2-carboxamido)propanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]3-((2S, 4R)-1-(1-hydroxy-1,3-dihydrobenzo[c][1,2]oxaborole-6-carbon yl)-4-(1-hydroxy-1,3-dihydrobenzo[c][1,2]oxaborole-6-carbox amido)pyrrolidine-2-carboxamido)propanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]3-((2S, 4R)-1-(1-hydroxy-1,3-dihydrobenzo[c][1,2]oxaborole-6-carbon yl)-4-(1-hydroxy-1,3-dihydrobenzo[c][1,2]oxaborole-6-carbox amido)pyrrolidine-2-carboxamido)propanoic acid modified residue
  DISULFID 12: note = Interchain disulfide bond with the cysteine at position 7 of SEQ ID NO: 25676
  DISULFID 24: note = Interchain disulfide bond with the cysteine at position 20 of SEQ ID NO: 25676

SEQ ID NO: 25678 - protein, 22 aa, synthetic construct
  SITE 22: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 6..11: note = Intrachain disulfide bond
  DISULFID 7: note = Interchain disulfide bond with the cysteine at position 12 of SEQ ID NO: 25679
  DISULFID 20: note = Interchain disulfide bond with the cysteine at position 24 of SEQ ID NO: 25679
GIVEQCCTSICSLYQLENYCGK

SEQ ID NO: 25679 - protein, 34 aa, synthetic construct; identical to SEQ ID NO: 25313
  SITE 1: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 5: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 26: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 12: note = Interchain disulfide bond with the cysteine at position 7 of SEQ ID NO: 25678
  DISULFID 24: note = Interchain disulfide bond with the cysteine at position 20 of SEQ ID NO: 25678

SEQ ID NO: 25680 - protein, 22 aa, synthetic construct
  SITE 22: note (R)-3-(3,4-bis(1-hydroxy-1,3-dihydrobenzo[c][1,2]oxaborole- 6-carboxamido)butanamido)propanoic acid modified residue
  DISULFID 6..11: note = Intrachain disulfide bond
  DISULFID 7: note = Interchain disulfide bond with the cysteine at position 12 of SEQ ID NO: 25681
  DISULFID 20: note = Interchain disulfide bond with the cysteine at position 24 of SEQ ID NO: 25681
GIVEQCCTSICSLYQLENYCGK

SEQ ID NO: 25681 - protein, 34 aa, synthetic construct; identical to SEQ ID NO: 25313
  SITE 1: note (R)-3-(3,4-bis(1-hydroxy-1,3-dihydrobenzo[c][1,2]oxaborole- 6-carboxamido)butanamido)propanoic acid modified residue
  SITE 5: note (R)-3-(3,4-bis(1-hydroxy-1,3-dihydrobenzo[c][1,2]oxaborole- 6-carboxamido)butanamido)propanoic acid modified residue
  SITE 26: note (R)-3-(3,4-bis(1-hydroxy-1,3-dihydrobenzo[c][1,2]oxaborole- 6-carboxamido)butanamido)propanoic acid modified residue
  DISULFID 12: note = Interchain disulfide bond with the cysteine at position 7 of SEQ ID NO: 25680
  DISULFID 24: note = Interchain disulfide bond with the cysteine at position 20 of SEQ ID NO: 25680

SEQ ID NO: 25682 - protein, 21 aa, synthetic construct
  DISULFID 6..11: note = Intrachain disulfide bond
  DISULFID 7: note = Interchain disulfide bond with the cysteine at position 13 of SEQ ID NO: 25683
  DISULFID 20: note = Interchain disulfide bond with the cysteine at position 25 of SEQ ID NO: 25683
GIVEQCCTSICSLYQLENYCN

SEQ ID NO: 25683 - protein, 35 aa, synthetic construct; identical to SEQ ID NO: 25228
  SITE 2: note (R)-3-(3,4-bis(1-hydroxy-1,3-dihydrobenzo[c][1,2]oxaborole- 6-carboxamido)butanamido)propanoic acid modified residue
  SITE 6: note (R)-3-(3,4-bis(1-hydroxy-1,3-dihydrobenzo[c][1,2]oxaborole- 6-carboxamido)butanamido)propanoic acid modified residue
  SITE 27: note (R)-3-(3,4-bis(1-hydroxy-1,3-dihydrobenzo[c][1,2]oxaborole- 6-carboxamido)butanamido)propanoic acid modified residue
  DISULFID 13: note = Interchain disulfide bond with the cysteine at position 7 of SEQ ID NO: 25682
  DISULFID 25: note = Interchain disulfide bond with the cysteine at position 20 of SEQ ID NO: 25682

SEQ ID NO: 25684 - protein, 21 aa, synthetic construct
  DISULFID 6..11: note = Intrachain disulfide bond
  DISULFID 7: note = Interchain disulfide bond with the cysteine at position 13 of SEQ ID NO: 25685
  DISULFID 20: note = Interchain disulfide bond with the cysteine at position 25 of SEQ ID NO: 25685
GIVEQCCTSICSLYQLENYCN

SEQ ID NO: 25685 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-phenylbutanoi c acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-phenylbutanoi c acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-phenylbutanoi c acid modified residue
  DISULFID 13: note = Interchain disulfide bond with the cysteine at position 7 of SEQ ID NO: 25684
  DISULFID 25: note = Interchain disulfide bond with the cysteine at position 20 of SEQ ID NO: 25684

SEQ ID NO: 25686 - protein, 21 aa, synthetic construct
  DISULFID 6..11: note = Intrachain disulfide bond
  DISULFID 7: note = Interchain disulfide bond with the cysteine at position 13 of SEQ ID NO: 25687
  DISULFID 20: note = Interchain disulfide bond with the cysteine at position 25 of SEQ ID NO: 25687
GIVEQCCTSICSLYQLENYCN

SEQ ID NO: 25687 - protein, 35 aa, synthetic construct; identical to SEQ ID NO: 25228
  SITE 2: note (R)-3-(4,5-bis(1-hydroxy-1,3-dihydrobenzo[c][1,2]oxaborole- 6-carboxamido)pentanamido)propanoic acid modified residue
  SITE 6: note (R)-3-(4,5-bis(1-hydroxy-1,3-dihydrobenzo[c][1,2]oxaborole- 6-carboxamido)pentanamido)propanoic acid modified residue
  SITE 27: note (R)-3-(4,5-bis(1-hydroxy-1,3-dihydrobenzo[c][1,2]oxaborole- 6-carboxamido)pentanamido)propanoic acid modified residue
  DISULFID 13: note = Interchain disulfide bond with the cysteine at position 7 of SEQ ID NO: 25686
  DISULFID 25: note = Interchain disulfide bond with the cysteine at position 20 of SEQ ID NO: 25686

SEQ ID NO: 25688 - protein, 21 aa, synthetic construct
  DISULFID 6..11: note = Intrachain disulfide bond
  DISULFID 7: note = Interchain disulfide bond with the cysteine at position 13 of SEQ ID NO: 25689
  DISULFID 20: note = Interchain disulfide bond with the cysteine at position 25 of SEQ ID NO: 25689
GIVEQCCTSICSLYQLENYCN

SEQ ID NO: 25689 - protein, 35 aa, synthetic construct; identical to SEQ ID NO: 25228
  SITE 2: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-5-phenylpentano ic acid modified residue
  SITE 6: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-5-phenylpentano ic acid modified residue
  SITE 27: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-5-phenylpentano ic acid modified residue
  DISULFID 13: note = Interchain disulfide bond with the cysteine at position 7 of SEQ ID NO: 25688
  DISULFID 25: note = Interchain disulfide bond with the cysteine at position 20 of SEQ ID NO: 25688

SEQ ID NO: 25690 - protein, 21 aa, synthetic construct
  DISULFID 6..11: note = Intrachain disulfide bond
  DISULFID 7: note = Interchain disulfide bond with the cysteine at position 13 of SEQ ID NO: 25691
  DISULFID 20: note = Interchain disulfide bond with the cysteine at position 25 of SEQ ID NO: 25691
GIVEQCCTSICSLYQLENYCN

SEQ ID NO: 25691 - protein, 35 aa, synthetic construct; identical to SEQ ID NO: 25228
  SITE 2: note 3-((2S,4S)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 6: note 3-((2S,4S)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  SITE 27: note 3-((2S,4S)-1-(4-fluoro-1-hydroxy-1,3-dihydrobenzo[c][1,2]ox aborole-6-carbonyl)-4-(4-fluoro-1-hydroxy-1,3-dihydrobenzo[ c][1,2]oxaborole-6-carboxamido)pyrrolidine-2-carboxamido)pr opanoic acid modified residue
  DISULFID 13: note = Interchain disulfide bond with the cysteine at position 7 of SEQ ID NO: 25690
  DISULFID 25: note = Interchain disulfide bond with the cysteine at position 20 of SEQ ID NO: 25690

SEQ ID NO: 25692 - protein, 21 aa, synthetic construct
  DISULFID 6..11: note = Intrachain disulfide bond
  DISULFID 7: note = Interchain disulfide bond with the cysteine at position 13 of SEQ ID NO: 25693
  DISULFID 20: note = Interchain disulfide bond with the cysteine at position 25 of SEQ ID NO: 25693
GIVEQCCTSICSLYQLENYCN

SEQ ID NO: 25693 - protein, 35 aa, synthetic construct; identical to SEQ ID NO: 25228
  SITE 2: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  SITE 6: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  SITE 27: note ((2S,4S)-1-(1-hydroxy-4-(trifluoromethyl)-1,3-dihydrobenzo[ c][1,2]oxaborole-6-carbonyl)-4-(1-hydroxy-4-(trifluoromethy l)-1,3-dihydrobenzo[c][1,2]oxaborole-6-carboxamido)pyrrolid ine-2-carbonyl)-L-aspartic acid modified residue
  DISULFID 13: note = Interchain disulfide bond with the cysteine at position 7 of SEQ ID NO: 25692
  DISULFID 25: note = Interchain disulfide bond with the cysteine at position 20 of SEQ ID NO: 25692

SEQ ID NO: 25694 - protein, 21 aa, synthetic construct
  DISULFID 6..11: note = Intrachain disulfide bond
  DISULFID 7: note = Interchain disulfide bond with the cysteine at position 12 of SEQ ID NO: 25695
  DISULFID 20: note = Interchain disulfide bond with the cysteine at position 24 of SEQ ID NO: 25695
GIVEQCCTSICSLYQLENYCG

SEQ ID NO: 25695 - protein, 34 aa, synthetic construct; identical to SEQ ID NO: 25313
  SITE 1: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-methylpentano ic acid modified residue
  SITE 5: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-methylpentano ic acid modified residue
  SITE 26: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-methylpentano ic acid modified residue
  DISULFID 12: note = Interchain disulfide bond with the cysteine at position 7 of SEQ ID NO: 25694
  DISULFID 24: note = Interchain disulfide bond with the cysteine at position 20 of SEQ ID NO: 25694

SEQ ID NO: 25696 - protein, 21 aa, synthetic construct
  DISULFID 6..11: note = Intrachain disulfide bond
  DISULFID 7: note = Interchain disulfide bond with the cysteine at position 13 of SEQ ID NO: 25697
  DISULFID 20: note = Interchain disulfide bond with the cysteine at position 25 of SEQ ID NO: 25697
GIVEQCCTSICSLYQLENYCN

SEQ ID NO: 25697 - protein, 35 aa, synthetic construct; identical to SEQ ID NO: 25228
  SITE 2: note 3-((2S,3S)-2-(4-fluoro-1-hydroxy-1,3-dihydrobenzo[c][1,2]ox aborole-6-carboxamido)-3-(1-hydroxy-1,3-dihydrobenzo[c][1,2 ]oxaborole-6-carboxamido)butanamido)propanoic acid modified residue
  SITE 6: note 3-((2S,3S)-2-(4-fluoro-1-hydroxy-1,3-dihydrobenzo[c][1,2]ox aborole-6-carboxamido)-3-(1-hydroxy-1,3-dihydrobenzo[c][1,2 ]oxaborole-6-carboxamido)butanamido)propanoic acid modified residue
  SITE 27: note 3-((2S,3S)-2-(4-fluoro-1-hydroxy-1,3-dihydrobenzo[c][1,2]ox aborole-6-carboxamido)-3-(1-hydroxy-1,3-dihydrobenzo[c][1,2 ]oxaborole-6-carboxamido)butanamido)propanoic acid modified residue
  DISULFID 13: note = Interchain disulfide bond with the cysteine at position 7 of SEQ ID NO: 25696
  DISULFID 25: note = Interchain disulfide bond with the cysteine at position 20 of SEQ ID NO: 25696

SEQ ID NO: 25698 - protein, 21 aa, synthetic construct
  DISULFID 6..11: note = Intrachain disulfide bond
  DISULFID 7: note = Interchain disulfide bond with the cysteine at position 12 of SEQ ID NO: 25699
  DISULFID 20: note = Interchain disulfide bond with the cysteine at position 24 of SEQ ID NO: 25699
GIVEQCCTSICSLYQLENYCG

SEQ ID NO: 25699 - protein, 34 aa, synthetic construct; identical to SEQ ID NO: 25313
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 5: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 26: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  DISULFID 12: note = Interchain disulfide bond with the cysteine at position 7 of SEQ ID NO: 25698
  DISULFID 24: note = Interchain disulfide bond with the cysteine at position 20 of SEQ ID NO: 25698

SEQ ID NO: 25700 - protein, 21 aa, synthetic construct
  DISULFID 6..11: note = Intrachain disulfide bond
  DISULFID 7: note = Interchain disulfide bond with the cysteine at position 13 of SEQ ID NO: 25701
  DISULFID 20: note = Interchain disulfide bond with the cysteine at position 25 of SEQ ID NO: 25701
GIVEQCCTSICSLYQLENYCN

SEQ ID NO: 25701 - protein, 35 aa, synthetic construct; identical to SEQ ID NO: 25228
  SITE 2: note ((2S,3S)-2,3-bis(1-hydroxy-1,3-dihydrobenzo[c][1,2]oxaborol e-6-carboxamido)butanoyl)-L-glutamic acid modified residue
  SITE 6: note ((2S,3S)-2,3-bis(1-hydroxy-1,3-dihydrobenzo[c][1,2]oxaborol e-6-carboxamido)butanoyl)-L-glutamic acid modified residue
  SITE 27: note ((2S,3S)-2,3-bis(1-hydroxy-1,3-dihydrobenzo[c][1,2]oxaborol e-6-carboxamido)butanoyl)-L-glutamic acid modified residue
  DISULFID 13: note = Interchain disulfide bond with the cysteine at position 7 of SEQ ID NO: 25700
  DISULFID 25: note = Interchain disulfide bond with the cysteine at position 20 of SEQ ID NO: 25700

SEQ ID NO: 25702 - protein, 21 aa, synthetic construct
  DISULFID 6..11: note = Intrachain disulfide bond
  DISULFID 7: note = Interchain disulfide bond with the cysteine at position 13 of SEQ ID NO: 25703
  DISULFID 20: note = Interchain disulfide bond with the cysteine at position 25 of SEQ ID NO: 25703
GIVEQCCTSICSLYQLENYCN

SEQ ID NO: 25703 - protein, 35 aa, synthetic construct; identical to SEQ ID NO: 25228
  SITE 2: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-phenylpropano ic acid modified residue
  SITE 6: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-phenylpropano ic acid modified residue
  SITE 27: note (R)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-3-phenylpropano ic acid modified residue
  DISULFID 13: note = Interchain disulfide bond with the cysteine at position 7 of SEQ ID NO: 25702
  DISULFID 25: note = Interchain disulfide bond with the cysteine at position 20 of SEQ ID NO: 25702

SEQ ID NO: 25704 - protein, 21 aa, synthetic construct
  DISULFID 6..11: note = Intrachain disulfide bond
  DISULFID 7: note = Interchain disulfide bond with the cysteine at position 11 of SEQ ID NO: 25705
  DISULFID 20: note = Interchain disulfide bond with the cysteine at position 23 of SEQ ID NO: 25705
GIVEQCCTSICSLYQLENYCG

SEQ ID NO: 25705 - protein, 33 aa, synthetic construct; identical to SEQ ID NO: 24061
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 25: note 3-((2S,3S)-2,3-bis(1-hydroxy-1,3-dihydrobenzo[c][1,2]oxabor ole-6-carboxamido)butanamido)propanoic acid modified residue
  DISULFID 11: note = Interchain disulfide bond with the cysteine at position 7 of SEQ ID NO: 25704
  DISULFID 23: note = Interchain disulfide bond with the cysteine at position 20 of SEQ ID NO: 25704

SEQ ID NO: 25706 - protein, 97 aa, synthetic construct
  DISULFID 19..83: note = Intrachain disulfide bond
  DISULFID 31..96: note = Intrachain disulfide bond
  DISULFID 82..87: note = Intrachain disulfide bond
MIEGGRGKGSHKFVNQHLCGSHLVEALYLVCGKRGFFYTPRTRREAEDLQVGQVELGGGPGAGSLQPLALEGSLQRGIVEQCCTSICSLYQLENYCN

SEQ ID NO: 25707 - protein, 97 aa, synthetic construct; identical to SEQ ID NO: 25706
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 8: note 3-((2S,3S)-2,3-bis(1-hydroxy-1,3-dihydrobenzo[c][1,2]oxabor ole-6-carboxamido)butanamido)propanoic acid modified residue
  SITE 12: note 3-((2S,3S)-2,3-bis(1-hydroxy-1,3-dihydrobenzo[c][1,2]oxabor ole-6-carboxamido)butanamido)propanoic acid modified residue
  SITE 33: note 3-((2S,3S)-2,3-bis(1-hydroxy-1,3-dihydrobenzo[c][1,2]oxabor ole-6-carboxamido)butanamido)propanoic acid modified residue
  DISULFID 19..83: note = Intrachain disulfide bond
  DISULFID 31..96: note = Intrachain disulfide bond
  DISULFID 82..87: note = Intrachain disulfide bond

SEQ ID NO: 25708 - protein, 111 aa, synthetic construct
  DISULFID 31..97: note = Intrachain disulfide bond
  DISULFID 43..110: note = Intrachain disulfide bond
  DISULFID 96..101: note = Intrachain disulfide bond
MIEGGRGKPGGGGSGGGGSGGGGSFVNQHLCGSHLVEALYLVCGDRGFFYTPKPRTRREAEDLQVGQVELGGGPGAGSLQPLALEGSLQRGIVEQCCTSICSLYQLENYCN

SEQ ID NO: 25709 - protein, 111 aa, synthetic construct; identical to SEQ ID NO: 25708
  SITE 1: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 8: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  SITE 53: note ((2S,3S)-2,3-bis(1-hydroxy-4-(trifluoromethyl)-1,3-dihydrob enzo[c][1,2]oxaborole-6-carboxamido)butanoyl)-L-glutamic acid modified residue
  DISULFID 31..97: note = Intrachain disulfide bond
  DISULFID 43..110: note = Intrachain disulfide bond
  DISULFID 96..101: note = Intrachain disulfide bond

SEQ ID NO: 25710 - protein, 97 aa, synthetic construct
  DISULFID 18..82: note = Intrachain disulfide bond
  DISULFID 30..95: note = Intrachain disulfide bond
  DISULFID 81..86: note = Intrachain disulfide bond
MIEGGRKGSHKFVNQHLCGSHLVEALYLVCGKRGFFYTPRTRREAEDLQVGQVELGGGPGAGSLQPLALEGSLQRGIVEQCCTSICSLYQLENYCGK

SEQ ID NO: 25711 - protein, 97 aa, synthetic construct; identical to SEQ ID NO: 25710
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 7: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 11: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 32: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 97: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  DISULFID 18..82: note = Intrachain disulfide bond
  DISULFID 30..95: note = Intrachain disulfide bond
  DISULFID 81..86: note = Intrachain disulfide bond

SEQ ID NO: 25712 - protein, 93 aa, synthetic construct
  DISULFID 15..79: note = Intrachain disulfide bond
  DISULFID 27..92: note = Intrachain disulfide bond
  DISULFID 78..83: note = Intrachain disulfide bond
MIEGGRKGSHKQHLCGSHLVEALYLVCGKRGFFYTPRTRREAEDLQVGQVELGGGPGAGSLQPLALEGSLQRGIVEQCCTSICSLYQLENYCG

SEQ ID NO: 25713 - protein, 93 aa, synthetic construct; identical to SEQ ID NO: 25712
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 7: note 3-((2S,3S)-2,3-bis(1-hydroxy-1,3-dihydrobenzo[c][1,2]oxabor ole-6-carboxamido)butanamido)propanoic acid modified residue
  SITE 11: note 3-((2S,3S)-2,3-bis(1-hydroxy-1,3-dihydrobenzo[c][1,2]oxabor ole-6-carboxamido)butanamido)propanoic acid modified residue
  SITE 29: note 3-((2S,3S)-2,3-bis(1-hydroxy-1,3-dihydrobenzo[c][1,2]oxabor ole-6-carboxamido)butanamido)propanoic acid modified residue
  DISULFID 15..79: note = Intrachain disulfide bond
  DISULFID 27..92: note = Intrachain disulfide bond
  DISULFID 78..83: note = Intrachain disulfide bond

SEQ ID NO: 25714 - protein, 96 aa, synthetic construct
  DISULFID 18..82: note = Intrachain disulfide bond
  DISULFID 30..95: note = Intrachain disulfide bond
  DISULFID 81..86: note = Intrachain disulfide bond
MIEGGRKGSHKFVNQHLCGSHLVEALYLVCGKRGFFYTPRTRREAEDLQVGQVELGGGPGAGSLQPLALEGSLQRGIVEQCCTSICSLYQLENYCG

SEQ ID NO: 25715 - protein, 96 aa, synthetic construct; identical to SEQ ID NO: 25714
  SITE 1: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 7: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 11: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  SITE 32: note (S)-3-((2S,4R)-1-(1-hydroxy-1,3-dihydrobenzo[c][1,2]oxaboro le-6-carbonyl)-4-(1-hydroxy-1,3-dihydrobenzo[c][1,2]oxaboro le-6-carboxamido)pyrrolidine-2-carboxamido)-4-(4-methoxyphe nyl)butanoic acid modified residue
  DISULFID 18..82: note = Intrachain disulfide bond
  DISULFID 30..95: note = Intrachain disulfide bond
  DISULFID 81..86: note = Intrachain disulfide bond

SEQ ID NO: 25716 - protein, 113 aa, synthetic construct
  DISULFID 36..99: note = Intrachain disulfide bond
  DISULFID 48..112: note = Intrachain disulfide bond
  DISULFID 98..103: note = Intrachain disulfide bond
MHHHHHHIEGGRGKGGGGSGGGGSGGGGSFVNQHLCGSHLVEALYLVCGERGFFYTPKRREAEDLQVGQVELGGGPGAGSLQPLALEGSLQRGIVEQCCTSICSLYQLENYCN

SEQ ID NO: 25717 - protein, 113 aa, synthetic construct; identical to SEQ ID NO: 25716
  SITE 1: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 14: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  SITE 58: note 3-((2S,3S)-2,3-bis(1-hydroxy-4-(trifluoromethyl)-1,3-dihydr obenzo[c][1,2]oxaborole-6-carboxamido)butanamido)propanoic acid modified residue
  DISULFID 36..99: note = Intrachain disulfide bond
  DISULFID 48..112: note = Intrachain disulfide bond
  DISULFID 98..103: note = Intrachain disulfide bond

SEQ ID NO: 25718 - protein, 97 aa, synthetic construct
  DISULFID 18..82: note = Intrachain disulfide bond
  DISULFID 30..95: note = Intrachain disulfide bond
  DISULFID 81..86: note = Intrachain disulfide bond
MIEGGRKGSHKFVDQHLCGSHLVEALYLVCGKRGFFYTPRTRREAEDLQVGQVELGGGPGAGSLQPLALEGSLQRGIVEQCCTSICSLYQLENYCGK

SEQ ID NO: 25719 - protein, 97 aa, synthetic construct; identical to SEQ ID NO: 25718
  SITE 1: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 11: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 32: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  SITE 97: note (1S,2S)-2-((2S,4R)-1-(1-hydroxy-1,3-dihydrobenzo[c][1,2]oxa borole-6-carbonyl)-4-(1-hydroxy-1,3-dihydrobenzo[c][1,2]oxa borole-6-carboxamido)pyrrolidine-2-carboxamido)cyclohexane- 1-carboxylic acid modified residue
  DISULFID 18..82: note = Intrachain disulfide bond
  DISULFID 30..95: note = Intrachain disulfide bond
  DISULFID 81..86: note = Intrachain disulfide bond

SEQ ID NO: 25720 - protein, 97 aa, synthetic construct
  DISULFID 19..83: note = Intrachain disulfide bond
  DISULFID 31..96: note = Intrachain disulfide bond
  DISULFID 82..87: note = Intrachain disulfide bond
MIEGGRGKGSHKFVNQHLCGSHLVEALYLVCGKRGFFYTRPTRREAEDLQVGQVELGGGPGAGSLQPLALEGSLQRGIVEQCCTSICSLYQLENYCN

SEQ ID NO: 25721 - protein, 97 aa, synthetic construct; identical to SEQ ID NO: 25720
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 8: note 3-((2S,3S)-2,3-bis(1-hydroxy-1,3-dihydrobenzo[c][1,2]oxabor ole-6-carboxamido)butanamido)propanoic acid modified residue
  SITE 12: note 3-((2S,3S)-2,3-bis(1-hydroxy-1,3-dihydrobenzo[c][1,2]oxabor ole-6-carboxamido)butanamido)propanoic acid modified residue
  SITE 33: note 3-((2S,3S)-2,3-bis(1-hydroxy-1,3-dihydrobenzo[c][1,2]oxabor ole-6-carboxamido)butanamido)propanoic acid modified residue
  DISULFID 19..83: note = Intrachain disulfide bond
  DISULFID 31..96: note = Intrachain disulfide bond
  DISULFID 82..87: note = Intrachain disulfide bond

SEQ ID NO: 25722 - protein, 92 aa, synthetic construct
  DISULFID 14..78: note = Intrachain disulfide bond
  DISULFID 26..91: note = Intrachain disulfide bond
  DISULFID 77..82: note = Intrachain disulfide bond
MIEGGRKFVNQHLCGSHLVEALYLVCGKRGFFYTPKTRREAEDLQVGQVELGGGPGAGSLQPLALEGSLQRGIVEQCCTSICSLYQLENYCN

SEQ ID NO: 25723 - protein, 92 aa, synthetic construct; identical to SEQ ID NO: 25722
  SITE 1: note (S)-3-(2,3-bis(1-hydroxy-1,3-dihydrobenzo[c][1,2]oxaborole- 6-carboxamido)-2-methylpropanamido)propanoic acid modified residue
  SITE 7: note (S)-3-(2,3-bis(1-hydroxy-1,3-dihydrobenzo[c][1,2]oxaborole- 6-carboxamido)-2-methylpropanamido)propanoic acid modified residue
  SITE 28: note (S)-3-(2,3-bis(1-hydroxy-1,3-dihydrobenzo[c][1,2]oxaborole- 6-carboxamido)-2-methylpropanamido)propanoic acid modified residue
  SITE 36: note (S)-3-(2,3-bis(1-hydroxy-1,3-dihydrobenzo[c][1,2]oxaborole- 6-carboxamido)-2-methylpropanamido)propanoic acid modified residue
  DISULFID 14..78: note = Intrachain disulfide bond
  DISULFID 26..91: note = Intrachain disulfide bond
  DISULFID 77..82: note = Intrachain disulfide bond

SEQ ID NO: 25724 - protein, 98 aa, synthetic construct
  DISULFID 23..84: note = Intrachain disulfide bond
  DISULFID 35..97: note = Intrachain disulfide bond
  DISULFID 83..88: note = Intrachain disulfide bond
MHHHHHHIEGGRKGSHFVNQHLCGSHLVEALYLVCGKRGFFYTPREAEDLQVGQVELGGGPGAGSLQPLALEGSLQRGIVEQCCTSICSLYQLENYCG

SEQ ID NO: 25725 - protein, 98 aa, synthetic construct; identical to SEQ ID NO: 25724
  SITE 1: note 3-((2S,3S)-2,3-bis(1-hydroxy-1,3-dihydrobenzo[c][1,2]oxabor ole-6-carboxamido)butanamido)propanoic acid modified residue
  SITE 13: note 3-((2S,3S)-2,3-bis(1-hydroxy-1,3-dihydrobenzo[c][1,2]oxabor ole-6-carboxamido)butanamido)propanoic acid modified residue
  SITE 37: note 3-((2S,3S)-2,3-bis(1-hydroxy-1,3-dihydrobenzo[c][1,2]oxabor ole-6-carboxamido)butanamido)propanoic acid modified residue
  DISULFID 23..84: note = Intrachain disulfide bond
  DISULFID 35..97: note = Intrachain disulfide bond
  DISULFID 83..88: note = Intrachain disulfide bond

SEQ ID NO: 25726 - protein, 6 aa, synthetic construct
GKGSHK

SEQ ID NO: 25727 - protein, 5 aa, synthetic construct
KGSHK

SEQ ID NO: 25728 - protein, 4 aa, synthetic construct
KGSH

SEQ ID NO: 25729 - protein, 17 aa, synthetic construct
GKGGGGSGGGGSGGGGS

SEQ ID NO: 25730 - protein, 32 aa, synthetic construct
EAEDLQVGQVELGGGPGAGSLQPLALEGSLQR

SEQ ID NO: 25731 - protein, 21 aa, Homo sapiens
  DISULFID 6..11: note = Intrachain disulfide bond
  DISULFID 7: note = Interchain disulfide bond with the cysteine at position 8 of SEQ ID NO: 25741
  DISULFID 20: note = Interchain disulfide bond with the cysteine at position 20 of SEQ ID NO: 25741
GIVEQCCTSICSLYQLENYCN

SEQ ID NO: 25732 - protein, 22 aa, Homo sapiens
  DISULFID 6..11: note = Intrachain disulfide bond
  DISULFID 7: note = Interchain disulfide bond with the cysteine at position 12 of SEQ ID NO: 25742
  DISULFID 20: note = Interchain disulfide bond with the cysteine at position 24 of SEQ ID NO: 25742
GIVEQCCTSICSLYQLENYCGK

SEQ ID NO: 25733 - protein, 21 aa, Homo sapiens
  DISULFID 6..11: note = Intrachain disulfide bond
  DISULFID 7: note = Interchain disulfide bond with the cysteine at position 11 of SEQ ID NO: 25743
  DISULFID 20: note = Interchain disulfide bond with the cysteine at position 23 of SEQ ID NO: 25743
GIVEQCCTSICSLYQLENYCN

SEQ ID NO: 25734 - protein, 21 aa, Homo sapiens
  DISULFID 6..11: note = Intrachain disulfide bond
  DISULFID 7: note = Interchain disulfide bond with the cysteine at position 8 of SEQ ID NO: 25744
  DISULFID 20: note = Interchain disulfide bond with the cysteine at position 20 of SEQ ID NO: 25744
GIVEQCCTSICSLYQLENYCN

SEQ ID NO: 25735 - protein, 21 aa, Homo sapiens
  DISULFID 6..11: note = Intrachain disulfide bond
  DISULFID 7: note = Interchain disulfide bond with the cysteine at position 9 of SEQ ID NO: 25745
  DISULFID 20: note = Interchain disulfide bond with the cysteine at position 21 of SEQ ID NO: 25745
GIVEQCCTSICSLYQLENYCN

SEQ ID NO: 25736 - protein, 21 aa, Homo sapiens
  DISULFID 6..11: note = Intrachain disulfide bond
  DISULFID 7: note = Interchain disulfide bond with the cysteine at position 24 of SEQ ID NO: 25746
  DISULFID 20: note = Interchain disulfide bond with the cysteine at position 36 of SEQ ID NO: 25746
GIVEQCCTSICSLYQLENYCN

SEQ ID NO: 25737 - protein, 21 aa, Homo sapiens
  DISULFID 6..11: note = Intrachain disulfide bond
  DISULFID 7: note = Interchain disulfide bond with the cysteine at position 13 of SEQ ID NO: 25738
  DISULFID 20: note = Interchain disulfide bond with the cysteine at position 25 of SEQ ID NO: 25738
GIVEQCCTSICSLYQLENYCN

SEQ ID NO: 25738 - protein, 35 aa, synthetic construct; identical to SEQ ID NO: 25228
  DISULFID 13: note = Interchain disulfide bond with the cysteine at position 7 of SEQ ID NO: 25737
  DISULFID 25: note = Interchain disulfide bond with the cysteine at position 20 of SEQ ID NO: 25737

SEQ ID NO: 25739 - protein, 22 aa, Homo sapiens
  DISULFID 6..11: note = Intrachain disulfide bond
  DISULFID 7: note = Interchain disulfide bond with the cysteine at position 12 of SEQ ID NO: 25740
  DISULFID 20: note = Interchain disulfide bond with the cysteine at position 24 of SEQ ID NO: 25740
GIVEQCCTSICSLYQLENYCGK

SEQ ID NO: 25740 - protein, 34 aa, synthetic construct; identical to SEQ ID NO: 25393
  DISULFID 12: note = Interchain disulfide bond with the cysteine at position 7 of SEQ ID NO: 25739
  DISULFID 24: note = Interchain disulfide bond with the cysteine at position 20 of SEQ ID NO: 25739

SEQ ID NO: 25741 - protein, 31 aa, synthetic construct; identical to SEQ ID NO: 24060
  DISULFID 8: note = Interchain disulfide bond with the cysteine at position 7 of SEQ ID NO: 25731
  DISULFID 20: note = Interchain disulfide bond with the cysteine at position 20 of SEQ ID NO: 25731

SEQ ID NO: 25742 - protein, 34 aa, synthetic construct; identical to SEQ ID NO: 25313
  DISULFID 12: note = Interchain disulfide bond with the cysteine at position 7 of SEQ ID NO: 25732
  DISULFID 24: note = Interchain disulfide bond with the cysteine at position 20 of SEQ ID NO: 25732

SEQ ID NO: 25743 - protein, 33 aa, synthetic construct; identical to SEQ ID NO: 24061
  DISULFID 11: note = Interchain disulfide bond with the cysteine at position 7 of SEQ ID NO: 25733
  DISULFID 23: note = Interchain disulfide bond with the cysteine at position 20 of SEQ ID NO: 25733

SEQ ID NO: 25744 - protein, 30 aa, synthetic construct; identical to SEQ ID NO: 24062
  DISULFID 8: note = Interchain disulfide bond with the cysteine at position 7 of SEQ ID NO: 25734
  DISULFID 20: note = Interchain disulfide bond with the cysteine at position 20 of SEQ ID NO: 25734

SEQ ID NO: 25745 - protein, 31 aa, synthetic construct; identical to SEQ ID NO: 24063
  DISULFID 9: note = Interchain disulfide bond with the cysteine at position 7 of SEQ ID NO: 25735
  DISULFID 21: note = Interchain disulfide bond with the cysteine at position 20 of SEQ ID NO: 25735

SEQ ID NO: 25746 - protein, 46 aa, synthetic construct; identical to SEQ ID NO: 25397
  DISULFID 24: note = Interchain disulfide bond with the cysteine at position 7 of SEQ ID NO: 25736
  DISULFID 36: note = Interchain disulfide bond with the cysteine at position 20 of SEQ ID NO: 25736

What is claimed is:

1. A compound selected from:

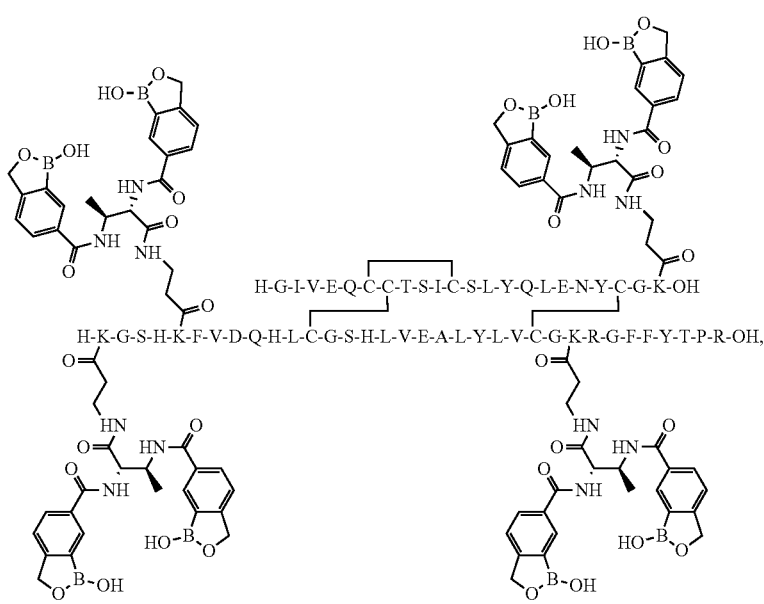

Example 3

Example 19
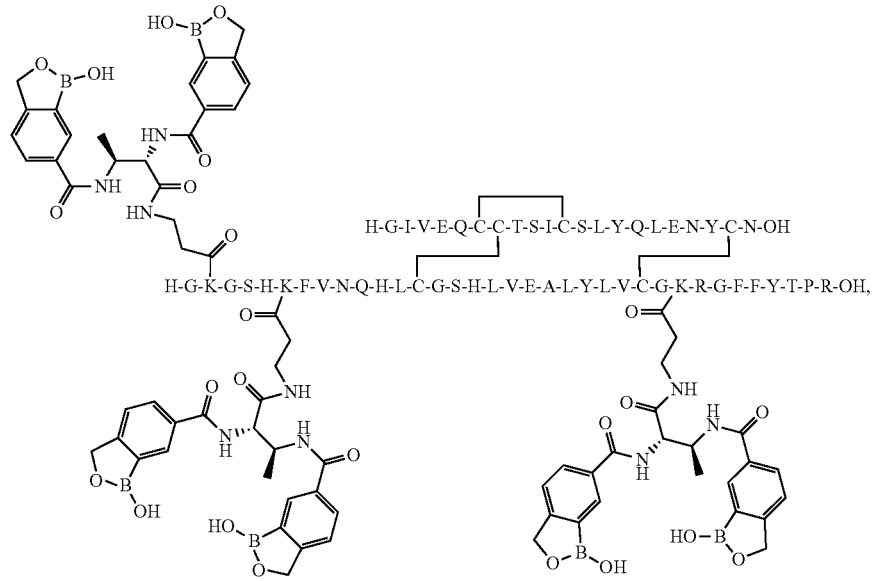
Example 23
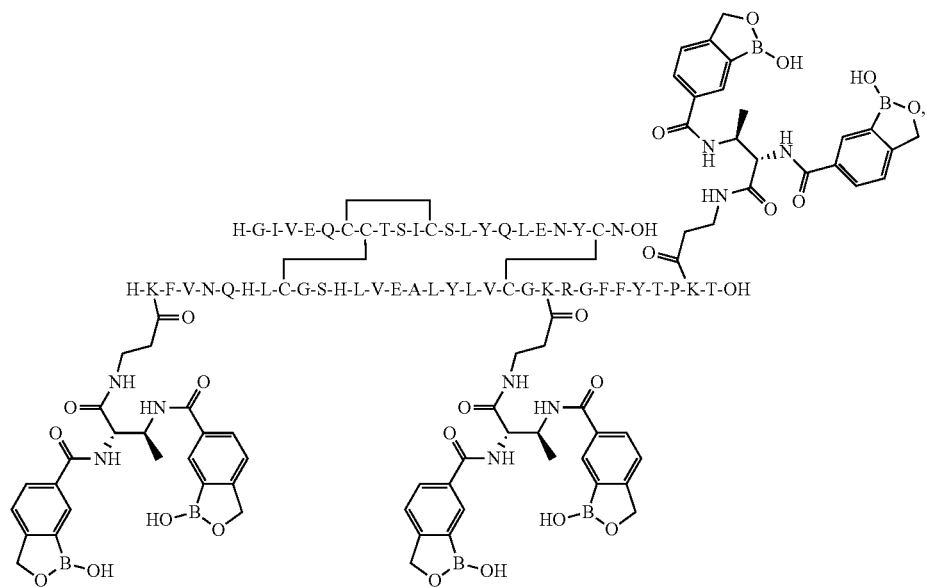

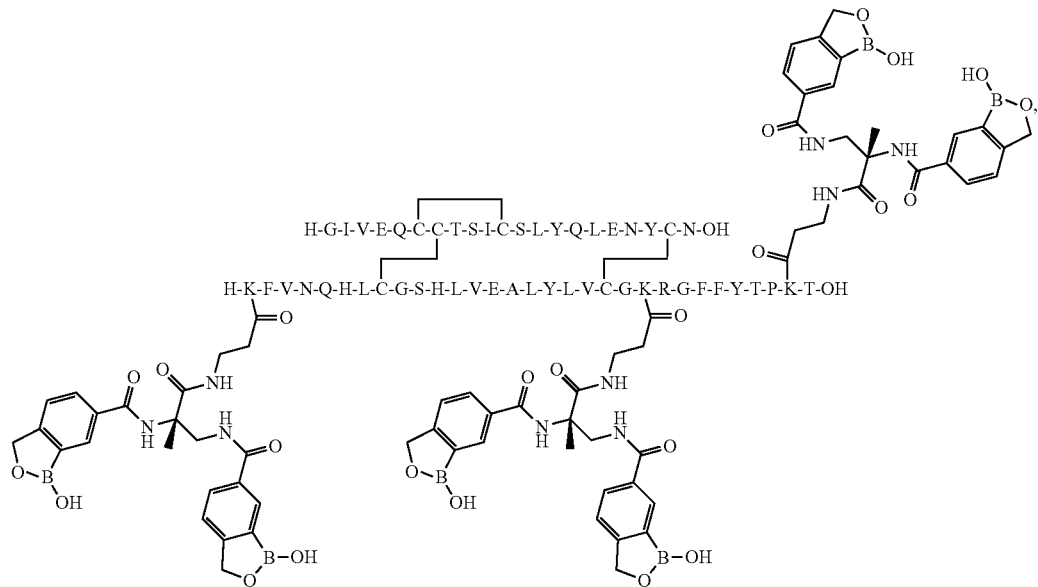
Example 27
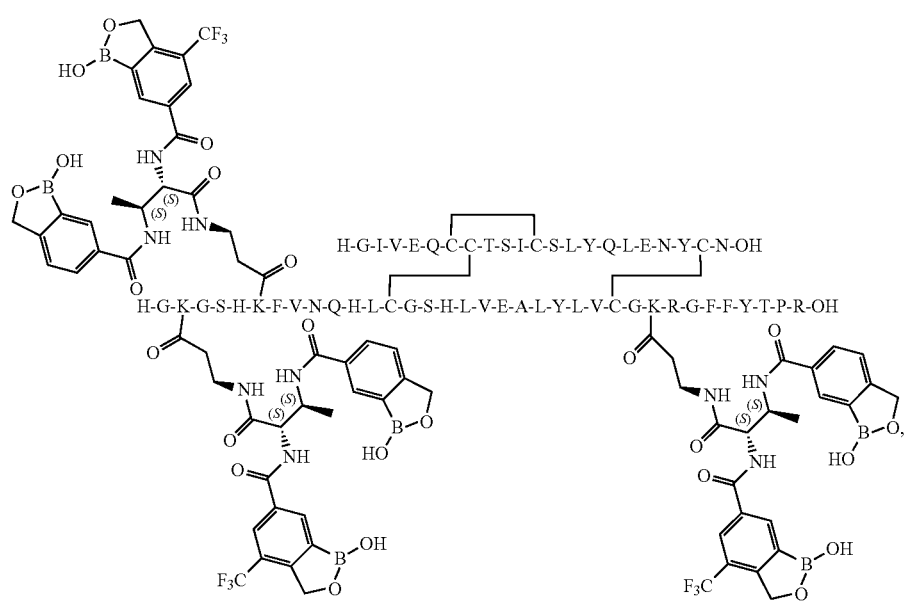
Example 41

-continued
Example 44
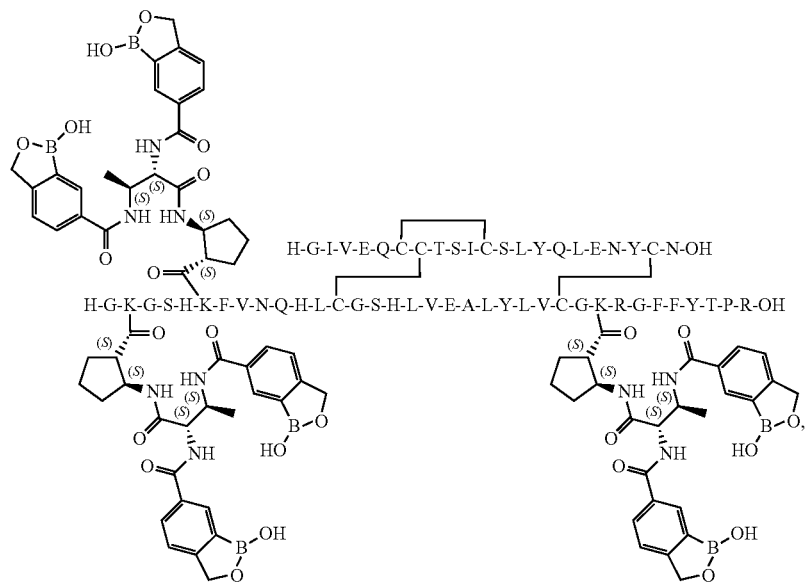
Example 48
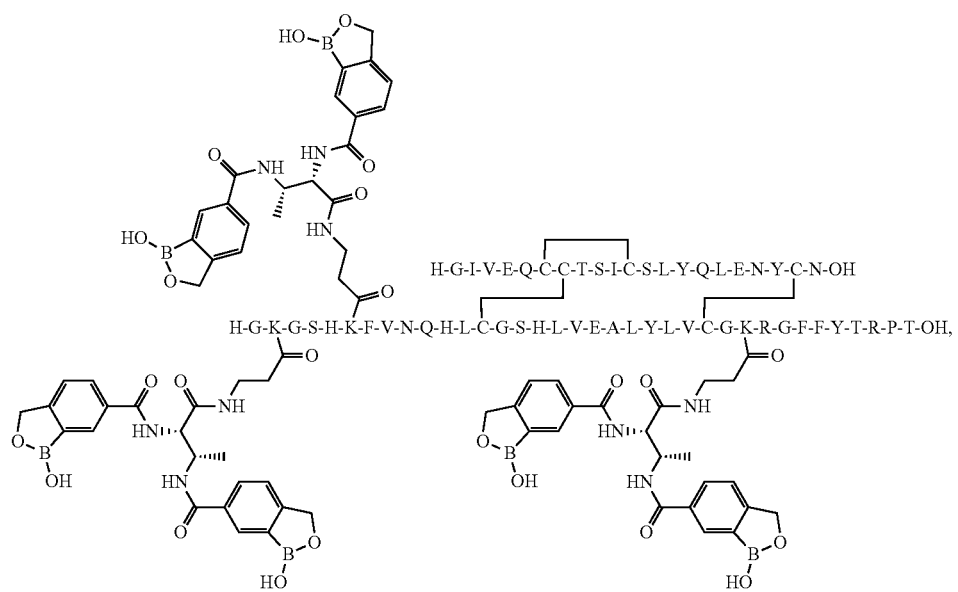

-continued
Example 55
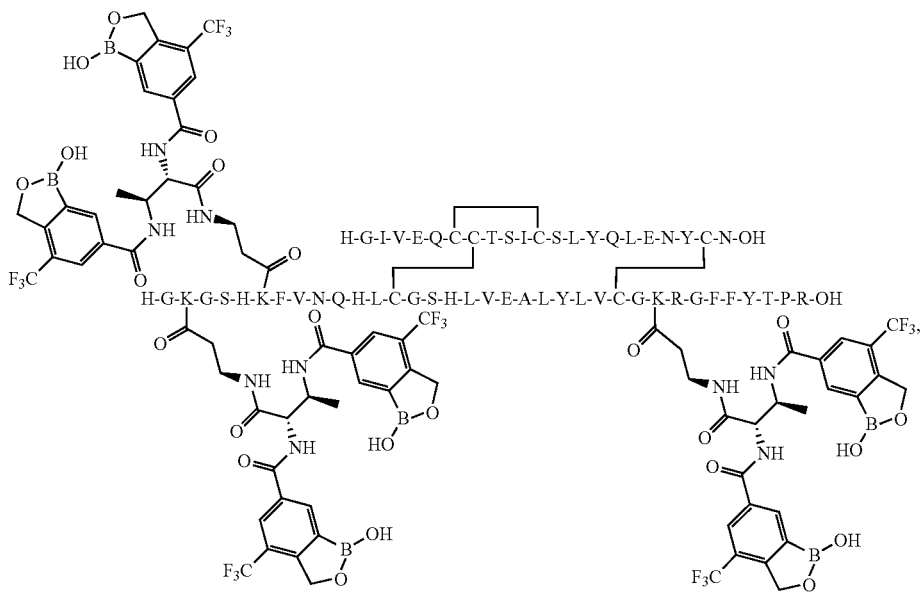
Example 56
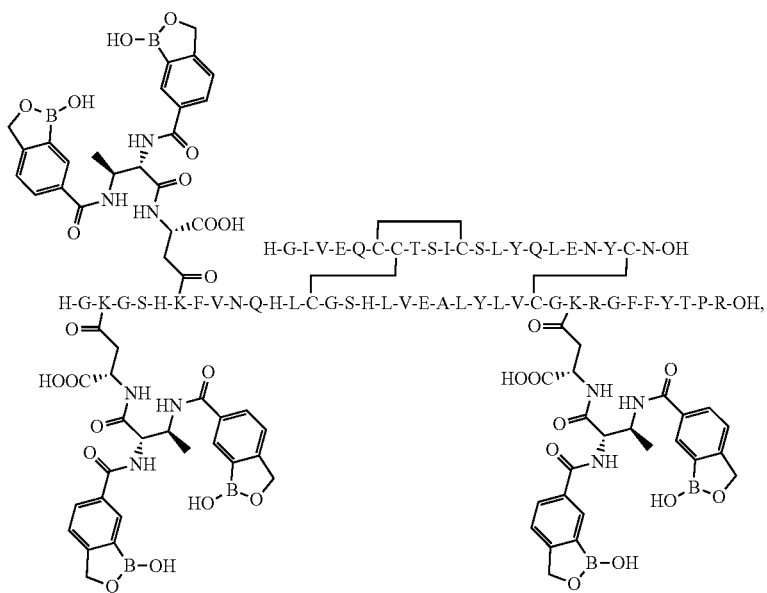

Example 69
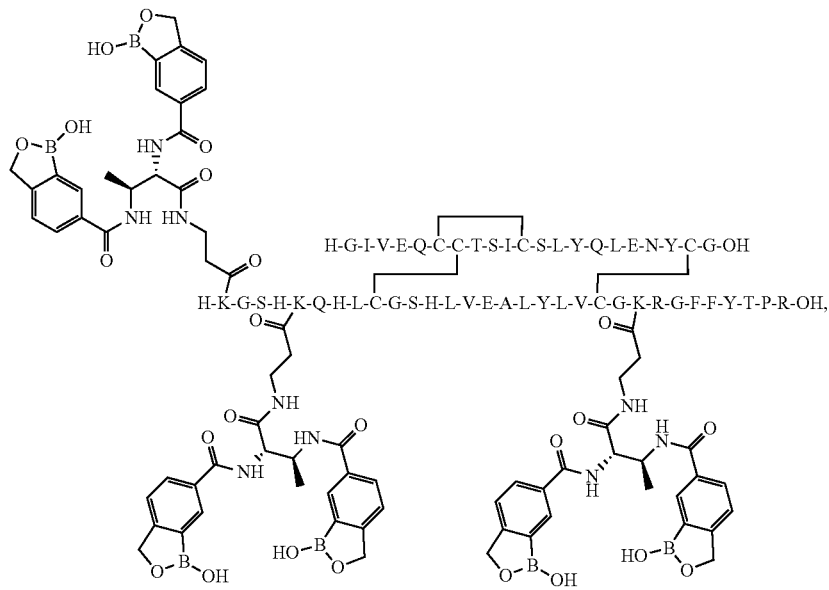
Example 76
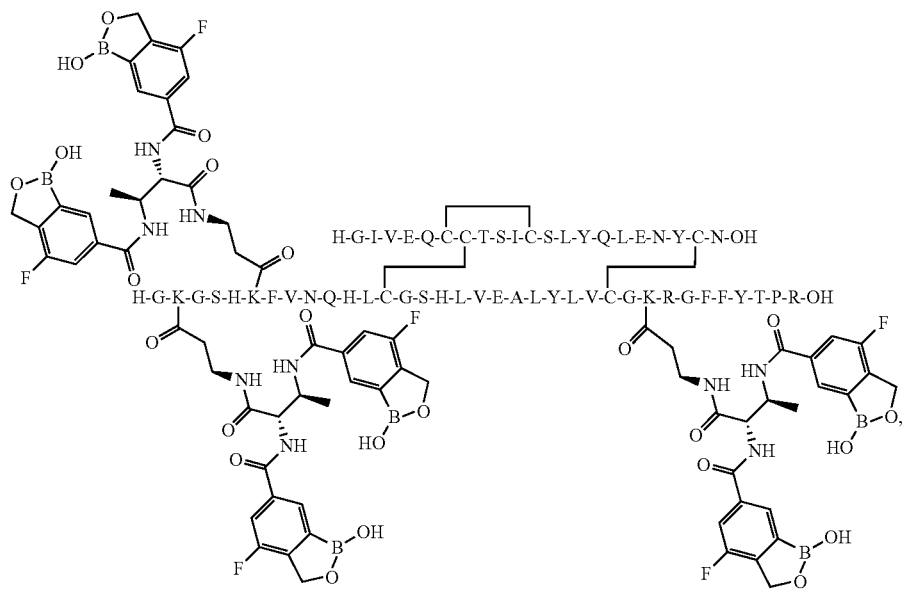
Example 131
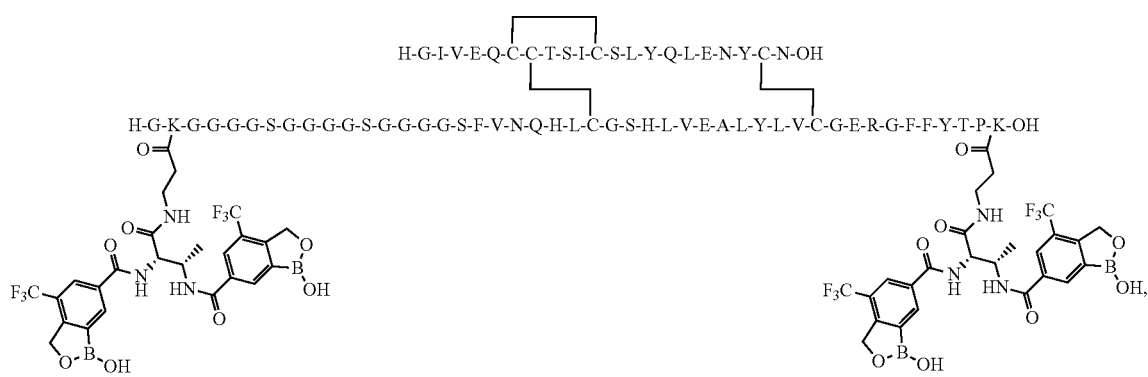

Example 140
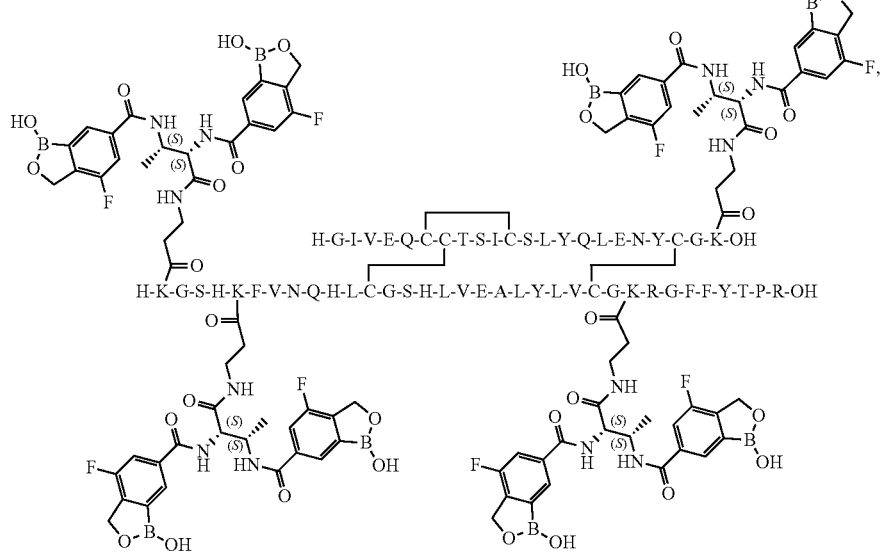
Example 152
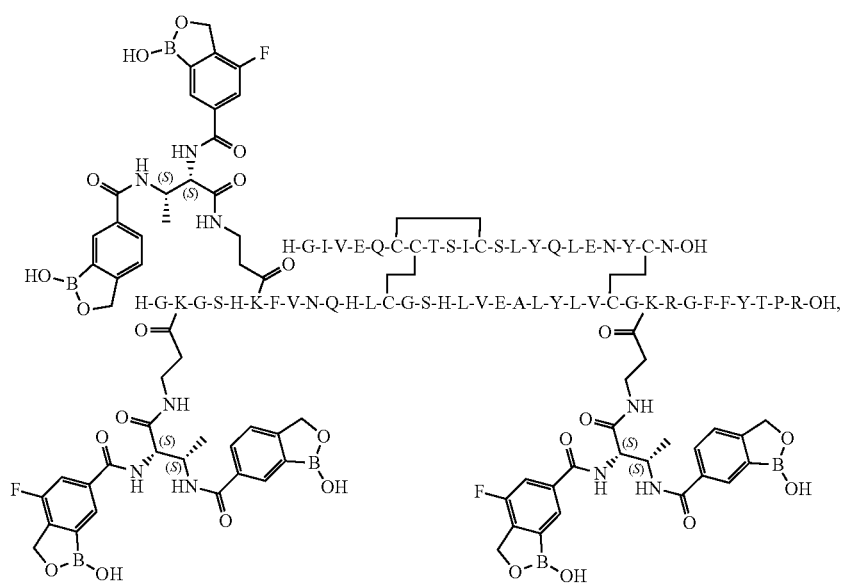

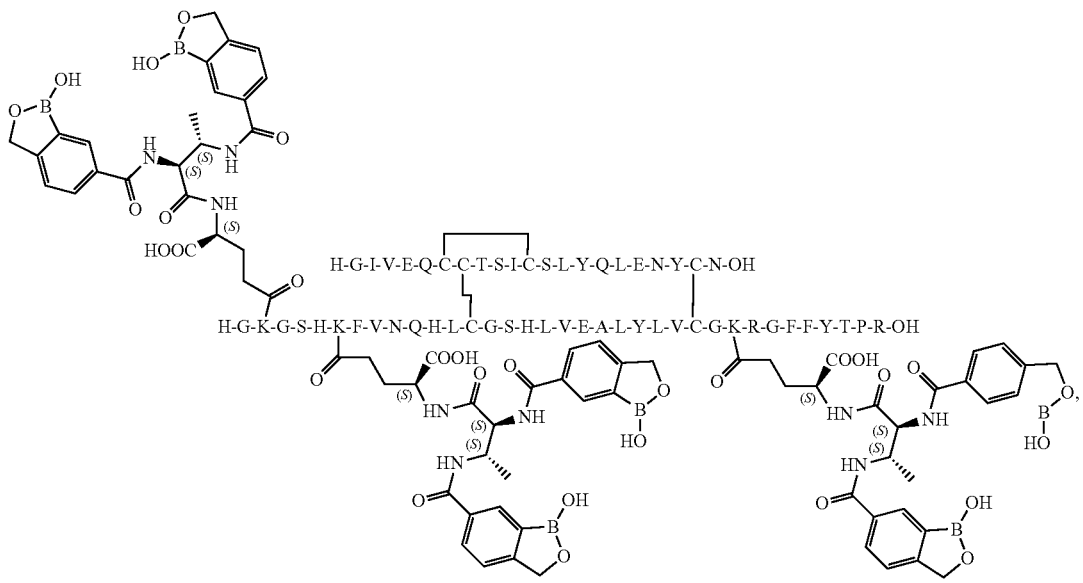

Example 154

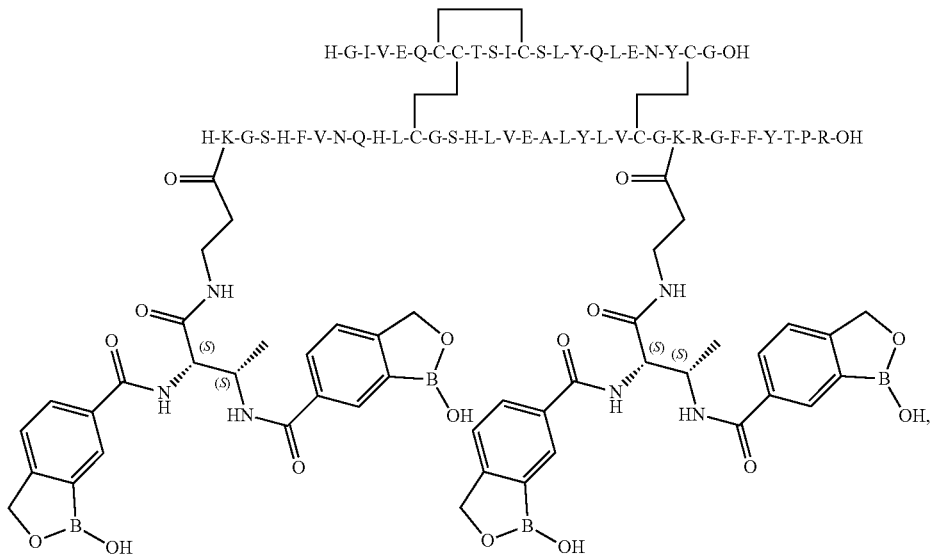

Example 156 and pharmaceutically acceptable salts thereof.

2. The compound according to claim 1, wherein the compound is Example 3 or a pharmaceutically acceptable salt thereof.

3. The compound according to claim 1, wherein the compound is Example 19 or a pharmaceutically acceptable salt thereof.

4. The compound according to claim 1, wherein the compound is Example 23 or a pharmaceutically acceptable salt thereof.

5. The compound according to claim 1, wherein the compound is Example 27 or a pharmaceutically acceptable salt thereof.

6. The compound according to claim 1, wherein the compound is Example 41 or a pharmaceutically acceptable salt thereof.

7. The compound according to claim 1, wherein the compound is Example 44 or a pharmaceutically acceptable salt thereof.

8. The compound according to claim 1, wherein the compound is Example 48 or a pharmaceutically acceptable salt thereof.

9. The compound according to claim 1, wherein the compound is Example 55 or a pharmaceutically acceptable salt thereof.

10. The compound according to claim 1, wherein the compound is Example 56 or a pharmaceutically acceptable salt thereof.

11. The compound according to claim 1, wherein the compound is Example 69 or a pharmaceutically acceptable salt thereof.

12. The compound according to claim 1, wherein the compound is Example 76 or a pharmaceutically acceptable salt thereof.

13. The compound according to claim 1, wherein the compound is Example 131 or a pharmaceutically acceptable salt thereof.

14. The compound according to claim 1, wherein the compound is Example 140 or a pharmaceutically acceptable salt thereof.

15. The compound according to claim 1, wherein the compound is Example 152 or a pharmaceutically acceptable salt thereof.

16. The compound according to claim 1, wherein the compound is Example 154 or a pharmaceutically acceptable salt thereof.

17. The compound according to claim 1, wherein the compound is Example 156 or a pharmaceutically acceptable salt thereof.

18. A pharmaceutical composition comprising at least one compound selected from Example 3, Example 19, Example 23, Example 27, Example 41, Example 44, Example 48, Example 55, Example 56, Example 69, Example 76, Example 131, Example 140, Example 152, Example 154, Example 156, and pharmaceutically acceptable salts thereof; and a pharmaceutically acceptable carrier.

19. The pharmaceutical composition according to claim 18, wherein the compound is Example 3 or a pharmaceutically acceptable salt thereof.

20. The pharmaceutical composition according to claim 18, wherein the compound is Example 19 or a pharmaceutically acceptable salt thereof.

21. The pharmaceutical composition according to claim 18, wherein the compound is Example 23 or a pharmaceutically acceptable salt thereof.

22. The pharmaceutical composition according to claim 18, wherein the compound is Example 27 or a pharmaceutically acceptable salt thereof.

23. The pharmaceutical composition according to claim 18, wherein the compound is Example 41 or a pharmaceutically acceptable salt thereof.

24. The pharmaceutical composition according to claim 18, wherein the compound is Example 44 or a pharmaceutically acceptable salt thereof.

25. The pharmaceutical composition according to claim 18, wherein the compound is Example 48 or a pharmaceutically acceptable salt thereof.

26. The pharmaceutical composition according to claim 18, wherein the compound is Example 55 or a pharmaceutically acceptable salt thereof.

27. The pharmaceutical composition according to claim 18, wherein the compound is Example 56 or a pharmaceutically acceptable salt thereof.

28. The pharmaceutical composition according to claim 18, wherein the compound is Example 69 or a pharmaceutically acceptable salt thereof.

29. The pharmaceutical composition according to claim 18, wherein the compound is Example 76 or a pharmaceutically acceptable salt thereof.

30. The pharmaceutical composition according to claim 18, wherein the compound is Example 131 or a pharmaceutically acceptable salt thereof.

31. The pharmaceutical composition according to claim 18, wherein the compound is Example 140 or a pharmaceutically acceptable salt thereof.

32. The pharmaceutical composition according to claim 18, wherein the compound is Example 152 or a pharmaceutically acceptable salt thereof.

33. The pharmaceutical composition according to claim 18, wherein the compound is Example 154 or a pharmaceutically acceptable salt thereof.

34. The pharmaceutical composition according to claim 18, wherein the compound is Example 156 or a pharmaceutically acceptable salt thereof.

35. A method of treating type 2 diabetes, type 1 diabetes, diabetes during pregnancy, pre-diabetes, a maturity-onset diabetes of the young (MODY), obesity, impaired glucose tolerance, hyperglycemia, or metabolic syndrome comprising administering to a subject in need thereof at least one compound selected from Example 3, Example 19, Example 23, Example 27, Example 41, Example 44, Example 48, Example 55, Example 56, Example 69, Example 76, Example 131, Example 140, Example 152, Example 154, Example 156, and pharmaceutically acceptable salts thereof; and a pharmaceutically acceptable carrier.

36. The method according to claim 35, wherein the compound is Example 3 or a pharmaceutically acceptable salt thereof.

37. The method according to claim 35, wherein the compound is Example 19 or a pharmaceutically acceptable salt thereof.

38. The method according to claim 35, wherein the compound is Example 23 or a pharmaceutically acceptable salt thereof.

39. The method according to claim 35, wherein the compound is Example 27 or a pharmaceutically acceptable salt thereof.

40. The method according to claim 35, wherein the compound is Example 41 or a pharmaceutically acceptable salt thereof.

41. The method according to claim 35, wherein the compound is Example 44 or a pharmaceutically acceptable salt thereof.

42. The method according to claim 35, wherein the compound is Example 48 or a pharmaceutically acceptable salt thereof.

43. The method according to claim 35, wherein the compound is Example 55 or a pharmaceutically acceptable salt thereof.

44. The method according to claim 35, wherein the compound is Example 56 or a pharmaceutically acceptable salt thereof.

45. The method according to claim 35, wherein the compound is Example 69 or a pharmaceutically acceptable salt thereof.

46. The method according to claim 35, wherein the compound is Example 76 or a pharmaceutically acceptable salt thereof.

47. The method according to claim 35, wherein the compound is Example 131 or a pharmaceutically acceptable salt thereof.

48. The method according to claim 35, wherein the compound is Example 140 or a pharmaceutically acceptable salt thereof.

49. The method according to claim 35, wherein the compound is Example 152 or a pharmaceutically acceptable salt thereof.

50. The method according to claim 35, wherein the compound is Example 154 or a pharmaceutically acceptable salt thereof.

51. The method according to claim 35, wherein the compound is Example 156 or a pharmaceutically acceptable salt thereof.

* * * * *